US011434490B2

(12) United States Patent
Ryckelynck et al.

(10) Patent No.: US 11,434,490 B2
(45) Date of Patent: Sep. 6, 2022

(54) FLUOROGEN-BINDING RNA APTAMERS

(71) Applicants: CENTRE NATIONAL DE LA RECHERCHE SCIENTIFIQUE, Paris (FR); UNIVERSITÉ DE STRASBOURG, Strasbourg (FR); SIMON FRASER UNIVERSITY, Burnaby (CA); THE UNITED STATES OF AMERICA, AS REPRESENTED BY THE SECRETARY, DEPARTMENT OF HEALTH AND HUMAN SERVICES, Rockville, MD (US)

(72) Inventors: Michael Ryckelynck, Strasbourg (FR); Alexis Autour, Strasbourg (FR); Peter Unrau, North Vancouver (CA); Elena Dolgosheina, Vancouver (CA); Sunny Chiu Yuk Jeng, Vancouver (CA); Shanker Shyam Sundhar Panchapakesan, North Madavilagam (IN); Amir Abdolahzadeh, Maple Ridge (CA); Razvan Cojocaru, Port Coquitlam (CA); Adrian Ferré D'Amaré, Rockville, MD (US); Robert Trachman, Rockville, MD (US)

(73) Assignees: Centre National De La Recherche, Paris (FR); Scientifique Université De Strasbourg, Strasbourg (FR); Simon Fraser University, Burnaby (CA); The United States of America, As Represented by The Secretary, Department of Health and Human Services, Rockville, MD (US)

( * ) Notice: Subject to any disclaimer, the term of this patent is extended or adjusted under 35 U.S.C. 154(b) by 124 days.

(21) Appl. No.: 16/608,127

(22) PCT Filed: Apr. 23, 2018

(86) PCT No.: PCT/IB2018/052808
§ 371 (c)(1),
(2) Date: Oct. 24, 2019

(87) PCT Pub. No.: WO2018/198013
PCT Pub. Date: Nov. 1, 2018

(65) Prior Publication Data
US 2020/0181618 A1 Jun. 11, 2020

Related U.S. Application Data

(60) Provisional application No. 62/489,346, filed on Apr. 24, 2017.

(51) Int. Cl.
*C12N 15/115* (2010.01)
*C12Q 1/68* (2018.01)

(52) U.S. Cl.
CPC ........ *C12N 15/115* (2013.01); *C12N 2310/16* (2013.01); *C12N 2320/10* (2013.01)

(58) Field of Classification Search
None
See application file for complete search history.

(56) References Cited

FOREIGN PATENT DOCUMENTS

WO 2013016694 1/2013

OTHER PUBLICATIONS

International Search Report and Written Opinion dated Jul. 5, 2018 in Application No. PCT/IB2018/052808.
Lawrence et al., "Shape Complementarity at Protein/ Protein Interfaces," J. Mol. Biol., 234, pp. 346-950.
Lorsch et al., "In Vitro Selection of RNA Aptamers Specific for Cyanocobalamin," Biochemistry, 33, pp. 973-982 (1994).
Leontis et al., "Geometric Nomenclature and Classification of RNA Base Pairs," RNA, 7, pp. 499-512 (2001).
Phan et al., "Small-Molecule Interaction with a Five-Guanine-Tract G-Quadruplex Structure from the Human MYC Promoter," Nature Chemical Biology, 1, pp. 167-173 (2005).
Shaner et al., "A Guide to Choosing Fluorescent Proteins," Nature Methods, 2, pp. 905-909 (2005).
Jarikote et al., "Exploring Base-Pair-Specific Optical Properties of the DNA Stain Thiazole Orange," Chem. Eur. J., 13, pp. 300-310 (2007).
McCoy et al., "Phaser Crystallographic Software," J. Appl. Cryst., 40, pp. 658-674 (2007).
Adams et al., "PHENIX: a comprehensive Python-Based System for Macromolecular Structure Solution," Acta Cryst., D66, pp. 213-221 (2010).
Emsley et al., "Features and Development of Coot," Acta Cryst., D66, pp. 486-501 (2010).
Kabsch, "XDS," Acta Cryst., D66, pp. 125-132 (2010).
Paige et al., "RNA Mimics of Green Fluorescent Protein," Science, 333, pp. 642-646 (2011).
Smirnov et al., "Biological Significance of 5S rRNA Import Into Human Mitochondria: Role of Ribosomal Protein MRP-L18," Genes & Development, 25, pp. 1289-1305 (2011).

(Continued)

*Primary Examiner* — Sean McGarry
(74) *Attorney, Agent, or Firm* — Snell & Wilmer L.L.P.

(57) ABSTRACT

RNA aptamers are disclosed with distinct fluorescent properties, fluorophore binding affinities, and salt dependence. Also disclosed are corresponding fluorophores, with selected fluorophores evidencing high cellular permeability. The aptamer's high fluorophore affinities, the high brightness of the bound complexes, and their thermal and salt stability, provide distinct aspects of the disclosed aptamers.

17 Claims, 40 Drawing Sheets
Specification includes a Sequence Listing.

(56) References Cited

OTHER PUBLICATIONS

Nicoludis et al., "Optimized End-Stacking Provides Specificity of N-Methyl Mesoporphyrin IX for Human Telomeric G-Quadruplex DNA," J. Am. Chem. Soc., 134, pp. 20446-20456 (2012).

Dolgosheina et al., "RNA Mango Aptamer-Fluorophore: A Bright, High-Affinity Complex for RNA Labeling and Tracking," ACS Chemical Biology, dx.doi.org/10.1021/cb500499x (2014).

Huang et al., "A G-Quadruplex-Containing RNA Activates Fluorescence in a GFP-Like Fluorophore," Nature Chemical Biology, 10, pp. 686-691 (2014).

Karunatilaka et al., "Post-transcriptional Modifications Modulate Conformational Dynamics in Human U2-U6 snRNA Complex," RNA, 20, pp. 16-23 (date unknown).

Warner et al., "Structural Basis for Activity of Highly Efficient RNA Mimics of Green Fluorescent Protein," Nature Structural & Molecular Biology, 8, pp. 658-663 (2014).

Filonov et al., "In-Gel Imaging of RNA Processing Using Broccoli Reveals Optimal Aptamer Expression Strategies," Chemistry & Biology, 22, pp. 649-660 (2015).

Ryckelynck et al., "Using Droplet-Based Microfluidics to Improve the Catalytic Properties of RNA Under Multiple-Turnover Conditions," RNA, 21, pp. 458-469 (not dated).

Autour et al., "iSpinach: a Fluorogenic RNA Aptamer Optimized for in Vitro Applications," Nucleic Acids Research, 44, pp. 2491-2500 (2016).

Dolgosheina et al., "Fluorophore-Binding RN Aaptamers and Their Applications," WIREs RNA, doi: 10.1002/wrna.1383 (2016).

Jeng et al., "Fluorophore Ligand Binding and Complex Stabilization of the RNA Mango and RNA Spinach Aptamers," RNA, 22, pp. 1884-1892 (not dated).

Rodriguez et al., "The Growing and Glowing Toolbox of Fluorescent and Photoactive Proteins," Trends in Biochemical Sciences, 42, 111-129 (2017).

Tan et al., "Fluoromodules Consisting of a Promiscuous RNA Aptamer and Red or Blue Fluorogenic Cyanine Dyes: Selection, Characterization, and Bioimaging," J. Am. Chem. Soc., DOI: 10.1021/jacs.7b04211 (2017).

Trachman III et al., "Structural basis for High-Affinity Fluorophore Binding and Activation by RNA Mango," Nature Chemical Biology (2017).

Trachman III et al., "Structural Principles of Fluorescent RNA Aptamers," Trends in Pharmacological Sciences, http://dx.doi.org/10.1016/j.tips.2017.06.007 (2017).

Autour et al., "Fluorogenic RNA Mango Aptamers for Imaging Small Non-Coding RNAs in Mammalian Cells," Nature Communications, 9, 656 (2018).

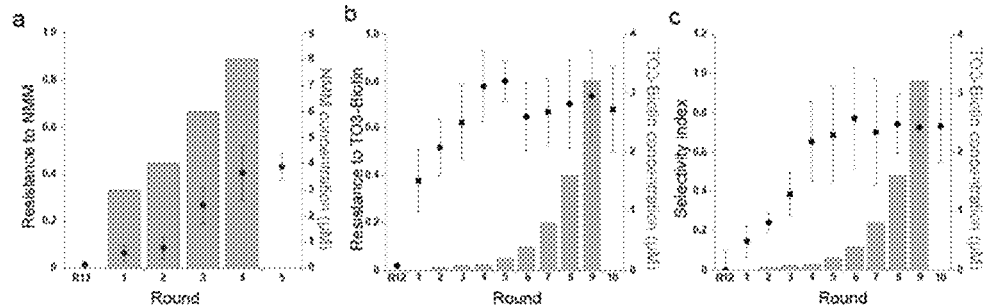
Figure 6
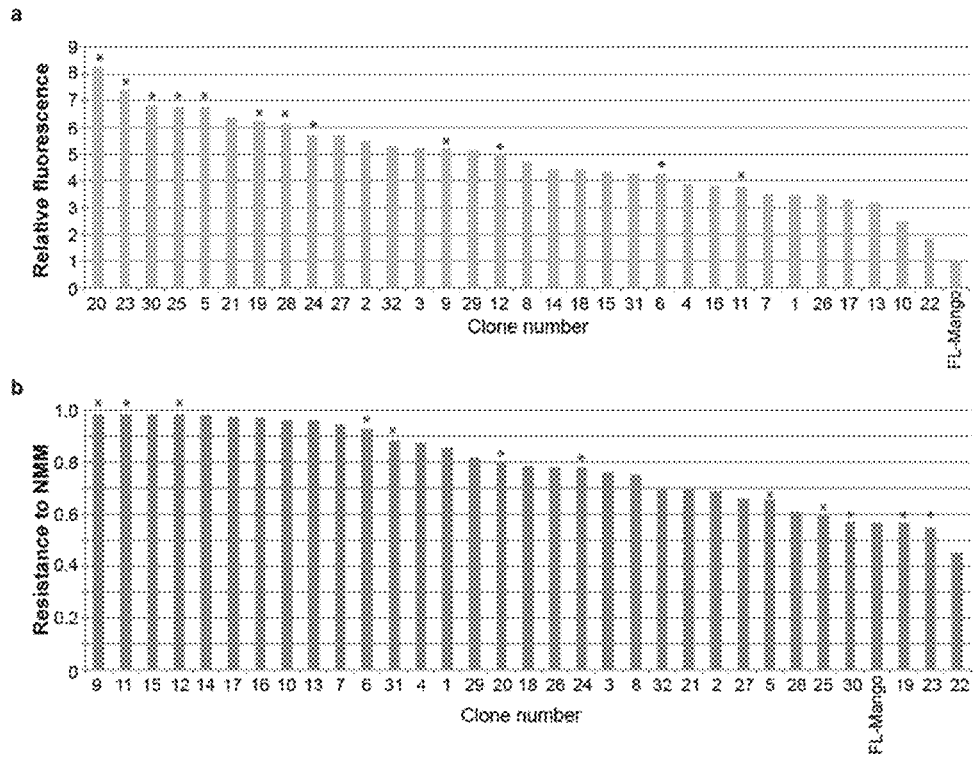
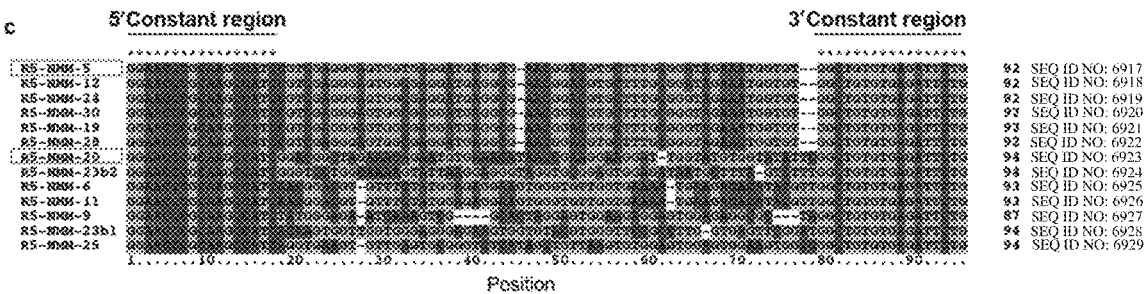
Figure 7

|  |  | Rel. F$_c$ | K$_D$ |  |
|---|---|---|---|---|
| R2-1 (full-length) | ...GTGCGTACC-GAA-GG-AGA-GG-AGA-GG-AAGA-GG-AGA-GTGCGCGTGTTG... | 1.0 ± 0.2 | 0.6 ± 0.1 | SEQ ID NO: 7005 |
| Mango II | GGCACGTAC-GAA-GG-AGA-GG-AGA-GG-AAGA-GG-AGA-GTACGTGC | 1.0 ± 0.2 | 0.3 ± 0.1 | SEQ ID NO: 7006 |
| Variant 1 | GGCACGTAC-GAA-GG-AGA-GG-TGC-GG---AGA-GG-AGA-GTACGTGC | 0.9 ± 0.2 | 3.5 ± 0.3 | SEQ ID NO: 7007 |
| Variant 2 | GGCACGTAC-GAA-GG-GAC-GG-AGA-GG---AGA-GG-AGA-GTACGTGC | 0.7 ± 0.1 | 7.1 ± 0.4 | SEQ ID NO: 7008 |
| Variant 3 | GGCACGTAC-GAA-GG-GAC-GG-TGC-GG-AAGA-GG-AGA-GTACGTGC | 1.1 ± 0.2 | 8.2 ± 1.7 | SEQ ID NO: 7009 |
| Variant 4 | GGCACGTAC-GAA-GG-AGA-GG-AGA-GG---AGA-GG-AGA-GTACGTGC | 0.7 ± 0.4 | 4.7 ± 0.8 | SEQ ID NO: 7010 |
| Variant 5 | GGCACGTAC-GAA-GG-AGA-GG-TGC-GG-AAGA-GG-AGA-GTACGTGC | 0.9 ± 0.2 | 0.9 ± 0.1 | SEQ ID NO: 7011 |
| Variant 6 | GGCACGTAC-GAA-GG-GAC-AGA-GG-AAGA-GG-AGA-GTACGTGC | 1.1 ± 0.1 | 12 ± 1 | SEQ ID NO: 7012 |
| Variant 7 | GGCACGTAC-GAA-GG-AGA-GG-AGA-GG-ATGA-GG-AGA-GTACGTGC | 0.9 ± 0.2 | 2.5 ± 0.3 | SEQ ID NO: 7013 |

Figure 9A

|  |  | Rel. F$_c$ | K$_D$ |  |
|---|---|---|---|---|
| R5-NMM-5 (full-length) | ...ACCCGCAAGCCATCCGT-CGA-GG-GAGT-GG-TGA-GG-ATGA-GG-CGA-ACGGACGTGCTTTG... | 1.0 ± 0.2 | 10 ± 1 | SEQ ID NO: 7014 |
| Mango IV | ------GGCACGTAC-CGA-GG-GAGT-GG-TGA-GG-ATGA-GG-CGA-GTACGTGC | 1.0 ± 0.2 | 13 ± 1 | SEQ ID NO: 7015 |
| Variant 1 | ---------------GG-GAGT-GG-TGA-GG-ATGA-GG-CGA-ACGGACGTGCTTTG... | 0.3 ± 0.1 | 78 ± 6 | SEQ ID NO: 7016 |
| Variant 2 | ---------------------------------------GGCGGACGTGCTTTG... | u.d. | u.d. | SEQ ID NO: 7017 |
| Variant 3 | GGCCGCAAGCCATCCGT-CGA-GG-GAGT-GG-TGA-GG-ATGA-GG-CGA-ACGGACGTGCTTTG... | 0.9 ± 0.1 | 28 ± 2 | SEQ ID NO: 7018 |
| Variant 4 | ------GGAAGCCTCCGT-CGA-GG-GAGT-GG-TGA-GG-ATGA-GG-CGA-ACGGAGTGCTT | 0.3 ± 0.2 | 7 ± 1 | SEQ ID NO: 7019 |
| Variant 5 | ------GGACGTACT-CGA-GG-GAGT-GG-TGA-GG-ATGA-GG-CGA-AGTACGT | 1.0 ± 0.2 | 7 ± 2 | SEQ ID NO: 7020 |
| Variant 6 | ---------GGCACGTA-CGA-GG-GAGT-GG-TGA-GG-ATGA-GG-CGA-GTACGTGC | 0.5 ± 0.1 | 18 ± 10 | SEQ ID NO: 7021 |
| Variant 7 | ---------GGCACGTAC-CAG-GG---AGT-GG-TGA-GG-ATGA-GG-CG--GTACGTGC | 0.8 ± 0.2 | 10 ± 3 | SEQ ID NO: 7022 |
| Variant 8 | ---------GGCACGTAC-GAA-GG-GAGT-GG-TGA-GG-ATGA-GG-AGA-GTACGTGC | 0.6 ± 0.1 | 20 ± 1 | SEQ ID NO: 7023 |
| Variant 9 | ---------GGCACGTAC-CGA-GG-GAC---GG-TGA-GG-ATGA-GG-CGA-GTACGTGC | 0.2 ± 0.1 | 260 ± 20 | SEQ ID NO: 7024 |
| Variant 10 | ---------GGCACGTAC-CGA-GG-GAGT-GG-TGC-GG-ATGA-GG-CGA-GTACGTGC | 0.9 ± 0.2 | 10 ± 1 | SEQ ID NO: 7025 |
| Variant 11 | ---------GGCACGTAC-CGA-GG-GAGT-GG-A--GA-GG-CGA-GTACGTGC | 0.5 ± 0.1 | 7 ± 1 | SEQ ID NO: 7026 |
| Variant 12 | ---------GGCACGTAC-CGA-GG-AAGT-GG-TGA-GG-ATGA-GG-CGA-GTACGTGC | 0.4 ± 0.1 | 70 ± 30 | SEQ ID NO: 7027 |
| Variant 13 | ---------GGCACGTAC-CGA-GG---AGT-GG-TGA-GG-ATGA-GG-CGA-GTACGTGC | 0.4 ± 0.1 | 6 ± 1 | SEQ ID NO: 7028 |
| Variant 14 | ---------GGCACGTAC-CGA-GG-GAAT-GG-TGA-GG-ATGA-GG-CGA-GTACGTGC | 0.3 ± 0.1 | 300 ± 30 | SEQ ID NO: 7029 |
| Variant 15 | ---------GGCACGTAC-CGA-GG-GA-T-GG-TGA-GG-ATGA-GG-CGA-GTACGTGC | 0.2 ± 0.1 | 140 ± 20 | SEQ ID NO: 7030 |
| Variant 16 | ---------GGCACGTAC-CGA-GG---AGA-GG-TGA-GG-ATGA-GG-CGA-GTACGTGC | 0.7 ± 0.2 | 7 ± 1 | SEQ ID NO: 7031 |
| Variant 17 | ---------GGCACGTAC-CGA-GG-GAGT-GG-TGA-GG-AAGA-GG-CGA-GTACGTGC | 0.6 ± 0.1 | 40 ± 2 | SEQ ID NO: 7032 |
| Variant 18 | ---------GGCACGTAC-CGA-GG-GAGT-GG-TGA-GG-ATGA-GG-AGA-GTACGTGC | 0.6 ± 0.1 | 26 ± 1 | SEQ ID NO: 7033 |
| Variant 19 | ---------GGCACGTAC-CGA-GG-GAGT-GG-TGA-GG-ATGA-GG-CAA-GTACGTGC | 0.8 ± 0.2 | 26 ± 4 | SEQ ID NO: 7034 |
| Variant 20 | ---------GGCACGTAC-GAA-GG-GAGT-GG-TGA-GG-ATGA-GG-CGA-GTACGTGC | 0.7 ± 0.1 | 40 ± 2 | SEQ ID NO: 7035 |

Figure 9B

|  |  | Rel. F$_c$ | K$_D$ |  |
|---|---|---|---|---|
| R5-NMM-28 (full-length) | ...GTGAAACATAACC-GAA-GG-AA-GG-ATT-GG-TATGT-GG-TATATTC-GGCTGTGTGAGATTCTG | 1.0 ± 0.1 | 14 ± 1 | SEQ ID NO: 7036 |
| Mango III | ----GGCACGTAC-GAA-GG-AA-GG-ATT-GG-TATGT-GG-TATATTC-GTACGTGCC | 1.0 ± 0.1 | 7.3 ± 0.4 | SEQ ID NO: 7037 |
| Variant 1 | ...GTGAAACATAACC-GAA-GG-AA-GG-ATT-GG-TATGT-GG-TATATTC-GGCTGTGTGAGATTCT | 0.9 ± 0.1 | 35 ± 2 | SEQ ID NO: 7038 |
| Variant 2 | ...GTGAAACATAACC-GAA-GG-AA-GG-ATT-GG-TATGT-GG-TATATTC-GGCTGTGTG | 0.6 ± 0.1 | 140 ± 8 | SEQ ID NO: 7039 |
| Variant 3 | GTGAAACATAACC-GAA-GG-AA-GG-ATT-GG-TATGT-GG-TATATTC-GGCTGTGTGAGATTCTG | 0.9 ± 0.1 | 170 ± 6 | SEQ ID NO: 7040 |
| Variant 4 | ---------GG-GAA-GG-AA-GG-ATT-GG-TATGT-GG-TATATTC-GGCTGTGTGAGATTCTG | 1.0 ± 0.1 | 15 ± 1 | SEQ ID NO: 7041 |
| Variant 5 | GTGAAACATAACC-GAA-GG-AA-GG-ATT-GG-TATGT-GG-TATATTC-GGCTGTGTG | 1.0 ± 0.1 | 12 ± 1 | SEQ ID NO: 7042 |
| Variant 6 | GTGAAACATAACC-GAA-GG-AA-GG-ATT-GG-TATGT-GG-TATATTC-GGCTGTGTG | 1.1 ± 0.1 | 52 ± 3 | SEQ ID NO: 7043 |
| Variant 7 | ---GGACATAACC-GAA-GG-AA-GG-ATT-GG-TATGT-GG-TATATTC-GGCTGTGTGAGATTCTG | 1.1 ± 0.1 | 12 ± 1 | SEQ ID NO: 7044 |
| Variant 8 | ----GGCACG-GAA-GG-AA-GG-ATT-GG-TATGT-GG-TATATTC-CGTGCC | 1.0 ± 0.1 | 5.6 ± 0.3 | SEQ ID NO: 7045 |
| Variant 9 | ----GGCACG-TAC-GG-AA-GG-ATT-GG-TATGT-GG-TATAGTA-CGTGCC | 1.0 ± 0.1 | 46 ± 3 | SEQ ID NO: 7046 |
| Variant 10 | ----GGCACG-GAA-GG-AA-GG-ATT-GG-TATGT-GG-TATA-----CGTGCC | u.d. | u.d. | SEQ ID NO: 7047 |
| Variant 11 | ----GGCACG------GG-AA-GG-ATT-GG-TATGT-GG-TATATTC-CGTGCC | u.d. | u.d. | SEQ ID NO: 7048 |

Figure 9C

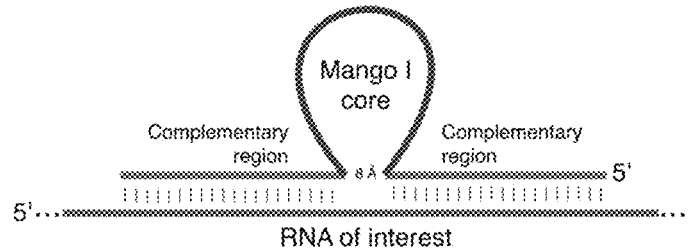

Figure 20

| Schematic | RFU | Schematic | RFU | Schematic | RFU | Schematic | RFU |
|---|---|---|---|---|---|---|---|
| SEQ ID NO: 7049 / SEQ ID NO: 7050 / SEQ ID NO: 7051 | 32 | SEQ ID NO: 7049 / SEQ ID NO: 7050 / SEQ ID NO: 7052 | 18 | SEQ ID NO: 7049 / SEQ ID NO: 7050 / SEQ ID NO: 7053 | 19 | SEQ ID NO: 7049 / SEQ ID NO: 7050 | 10 |
| SEQ ID NO: 7049 / SEQ ID NO: 7054 / SEQ ID NO: 7051 | 27 | SEQ ID NO: 7049 / SEQ ID NO: 7054 / SEQ ID NO: 7052 | 23 | SEQ ID NO: 7049 / SEQ ID NO: 7054 / SEQ ID NO: 7053 | 18 | SEQ ID NO: 7049 / SEQ ID NO: 7054 | 7 |
| SEQ ID NO: 7055 / SEQ ID NO: 7050 / SEQ ID NO: 7051 | 31 | SEQ ID NO: 7055 / SEQ ID NO: 7050 / SEQ ID NO: 7052 | 24 | SEQ ID NO: 7055 / SEQ ID NO: 7050 / SEQ ID NO: 7053 | 38 | SEQ ID NO: 7055 / SEQ ID NO: 7050 | 6 |
| SEQ ID NO: 7055 / SEQ ID NO: 7054 / SEQ ID NO: 7051 | 37 | SEQ ID NO: 7055 / SEQ ID NO: 7054 / SEQ ID NO: 7052 | 18 | SEQ ID NO: 7055 / SEQ ID NO: 7054 / SEQ ID NO: 7053 | 32 | SEQ ID NO: 7055 / SEQ ID NO: 7054 | 5 |
| SEQ ID NO: 7055 / SEQ ID NO: 7056 / SEQ ID NO: 7051 | 25 | SEQ ID NO: 7055 / SEQ ID NO: 7056 / SEQ ID NO: 7052 | 21 | SEQ ID NO: 7055 / SEQ ID NO: 7056 / SEQ ID NO: 7053 | 37 | SEQ ID NO: 7055 / SEQ ID NO: 7056 | 5 |
| SEQ ID NO: 7057 / SEQ ID NO: 7054 / SEQ ID NO: 7051 | 57 | SEQ ID NO: 7057 / SEQ ID NO: 7054 / SEQ ID NO: 7052 | 17 | SEQ ID NO: 7057 / SEQ ID NO: 7054 / SEQ ID NO: 7053 | 43 | SEQ ID NO: 7057 / SEQ ID NO: 7054 | 8 |
| SEQ ID NO: 7051 | 101 | SEQ ID NO: 7052 | 94 | SEQ ID NO: 7053 | 93 | | 100 |

Figure 21

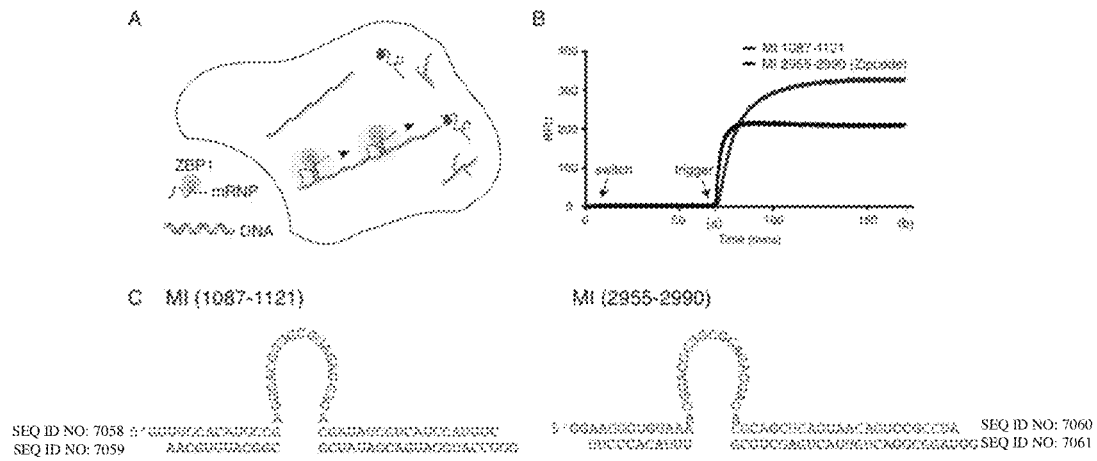
Figure 22
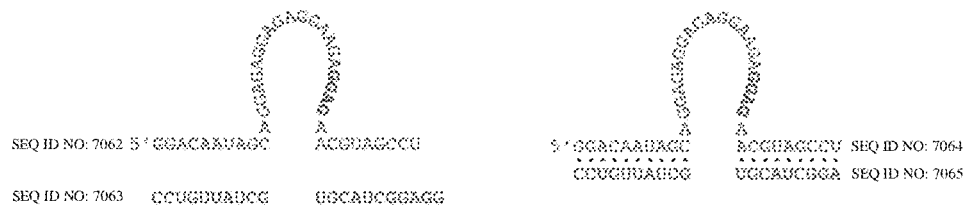
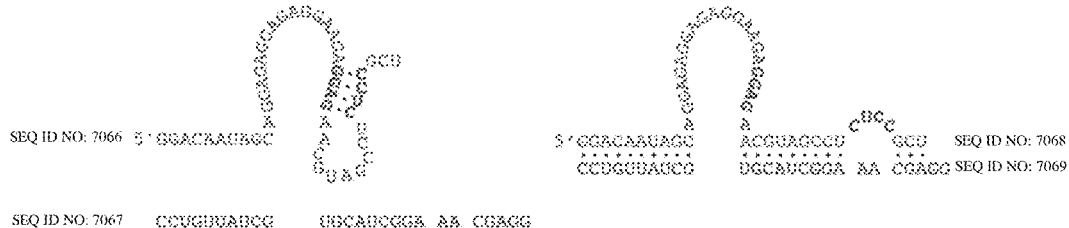
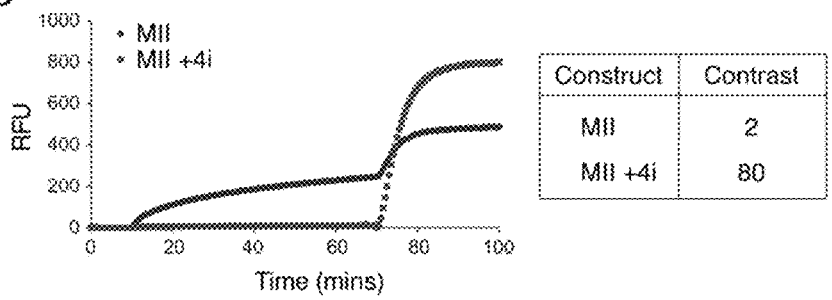
Figure 23

A

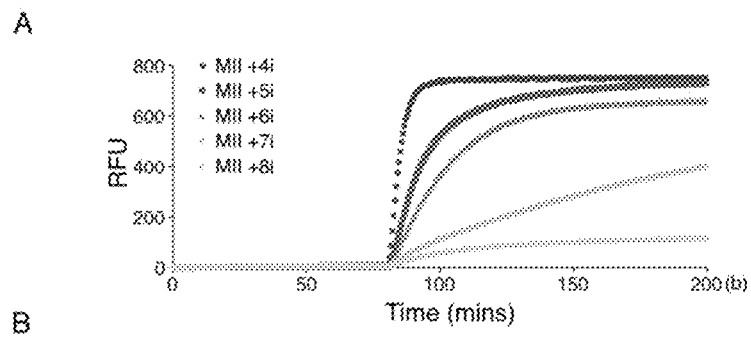

B

| Name | Mango II bipartite switch | Contrast | |
|---|---|---|---|
| MII +4i | ggacaatagca aggagaggacaggaagaggaga acgtagccta CUCC ccccc | 80 | SEQ ID NO: 7070 |
| MII +5i | ggacaatagca agcagaggacaggaaGAGGAGA acgtagccta CUCCU ccccc | 158 | SEQ ID NO: 7071 |
| MII +6i | ggacaatagca aggagaggacaggaAGAGGAGA acgtagccta CUCCUC ccccc | 150 | SEQ ID NO: 7072 |
| MII +7i | ggacaatagca aggagaggacaggaAGAGGAGA acgtagccta CUCCUCU ccccc | 80 | SEQ ID NO: 7073 |
| MII +8i | ggacaatagca aggagaggacaggaAGAGGAGA acgtagccta CUCCUCUU ccccc | 19 | SEQ ID NO: 7074 |

Figure 24

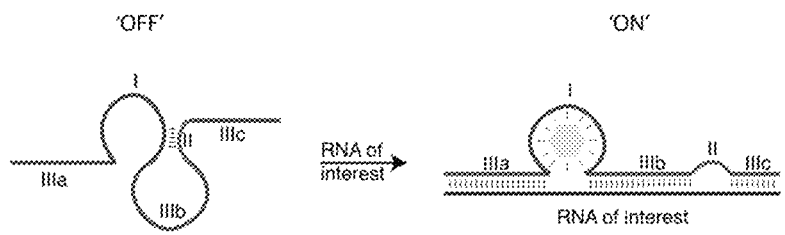

Figure 25

| Sequence Names | Piece 1 | |
|---|---|---|
| Consensus | GGACAATAGCA--GA-GGGAGTGGTGAGGATGAGG-CX--AACGTAGCCT | SEQ ID NO: 7075 |
| 12 Sequences | 10        20        30        40        50 | |
| MIV.1.seq | GGACAATAGCA-----GGGAGTGGTGAGGATGAGG-----AACGTAGCCT | SEQ ID NO: 7076 |
| MIV.2.seq | GGACAATAGCA---A-GGGAGTGGTGAGGATGAGG-----AACGTAGCCT | SEQ ID NO: 7077 |
| MIV.3.seq | GGACAATAGCA---GA-GGGAGTGGTGAGGATGAGG----AACGTAGCCT | SEQ ID NO: 7078 |
| MIV.4.seq | GGACAATAGCA---A-GGGAGTGGTGAGGATGAGG-C---AACGTAGCCT | SEQ ID NO: 7079 |
| MIV.5.seq | GGACAATAGCA---A-GGGAGTGGTGAGGATGAGG-CG--AACGTAGCCT | SEQ ID NO: 7080 |
| MIV.6.seq | GGACAATAGCA---A-GGGAGTGGTGAGGATGAGG-CGA-AACGTAGCCT | SEQ ID NO: 7081 |
| MIV.7.seq | GGACAATAGCA--GA-GGGAGTGGTGAGGATGAGG-C---AACGTAGCCT | SEQ ID NO: 7082 |
| MIV.8.seq | GGACAATAGCA--GA-GGGAGTGGTGAGGATGAGG-CG--AACGTAGCCT | SEQ ID NO: 7083 |
| MIV.9.seq | GGACAATAGCA--GA-GGGAGTGGTGAGGATGAGG-CGA-AACGTAGCCT | SEQ ID NO: 7084 |
| MIV.10.seq | GGACAATAGCA-CGA-GGGAGTGGTGAGGATGAGG-C---AACGTAGCCT | SEQ ID NO: 7085 |
| MIV.11.seq | GGACAATAGCA-CGA-GGGAGTGGTGAGGATGAGG-CG--AACGTAGCCT | SEQ ID NO: 7086 |
| MIV.12.seq | GGACAATAGCA-CGA-GGGAGTGGTGAGGATGAGG-CGA-AACGTAGCCT | SEQ ID NO: 7087 |

Figure 26

| Construct | Contrast |
|---|---|
| MIV.4 | 2.2120 |
| MIV.5 | 3.0303 |
| MIV.6 | 2.8747 |
| MIV.7 | 2.4497 |
| MIV.8 | 4.1781 |
| MIV.9 | 4.4402 |
| MIV.10 | 5.1584 |
| MIV.11 | 14.4080 |
| MIV.12 | 14.0661 |
| MIV | 1.5470 |

Figure 27

SEQ ID NO: 7088
MII.HBAZ1 targets mRNA in zipcode region 5' TAGGCGGACTATGACTTAGTTGCGTTACACCCTTTC 5'GG GAAAGGGTGTAA A GGAG A GGAG A GGAAGA GGAG A CGCAACTAAGTC CTCCT TCCGCCTA SEQ ID NO: 7089

3'   CTTTCCCACATT ------------------------- GCGTTGATTCAG ----- AGGCGGAT SEQ ID NO: 7090

SEQ ID NO: 7091
MII.HBA1 targets human beta actin 5' CGAGGCCCAGAGAGAGAGGCATCCTCACCCTGAAGT
SEQ ID NO: 7092
5'GG ACTTCAGGGTGA A GGAG A GGAG A GGAAGA GGAG A GGATGCCTCTCT CTCCT CTCTGGGCCTCG 3'   TGAAGTCCCACT ------------------------- CCTACGGAGAGA -AC-- GAGACCCGGAGC GG
SEQ ID NO: 7093

MII.HBA2 targets human beta actin 5' GGCACCCAGCACAATGAAGATCAAGATCATTG SEQ ID NO: 7094

5'GG CAATGATCTT A GGAG A GGAG A GGAAGA GGAG A GATCTTCATT CTCCT GTGCTGGGTG SEQ ID NO: 7095

3'   GTTACTAGAA --------------------------- CTAGAAGTAA ----- CACGACCCAC GG SEQ ID NO: 7096

MII.HBA3 targets human beta actin 5' AACTGGAACGGTGAAGGTGACAGCAGTCGG SEQ ID NO: 7097

5'GG CCGACTGCTG A GGAG A GGAG A GGAAG A GGAG A TCACCTTCAC CTCCT CGTTCCAGTT SEQ ID NO: 7098

3'   GGCTGACGAC ---------------------------- AGTGGAAGTG ------ GCAAGGTCAA GG SEQ ID NO: 7099

MI.B2 (targets mouse beta actin mRNA 1087 - 1121) sequence conserved in humans
5'GG UUGCACAUGCCG A GGGACGGUGCGGAGAGGAG A GAGCCGUUGU CUCC ACGACCAGCGC SEQ ID NO: 7100
3'   ...AACGUGUACGGC ------------------------ CUCGGCAACA -GC- UGCUGGUCGCG... SEQ ID NO: 7101

MII.B2 (targets mouse beta actin mRNA 1087 - 1121) sequence conserved in humans
5'GG UUGCACAUGCCG A GGAGAGGAGAGGAAGAGGAG A GAGCCGUUGU CUCCU ACGACCAGCGC SEQ ID NO: 7102
3'   ...AACGUGUACGGC ------------------------- CUCGGCAACA -GC--- UGCUGGUCGCG... SEQ ID NO: 7103

MII.O4 (RNA Mango II Probe for osk mRNA in drosophila from 970-1009)
5'GGCGCATTTACGCTG A GGAGAGGAGAGGAAGAGGAG A GCTTGCTGGTAGAAA CTCCT TTGTTGAGAT SEQ ID NO: 7104
3'CCGCGTAAATGCGAC ------------------------- CGAACGACCATCTTT ----- AACAACTCTA GG
SEQ ID NO: 7105

Figure 28

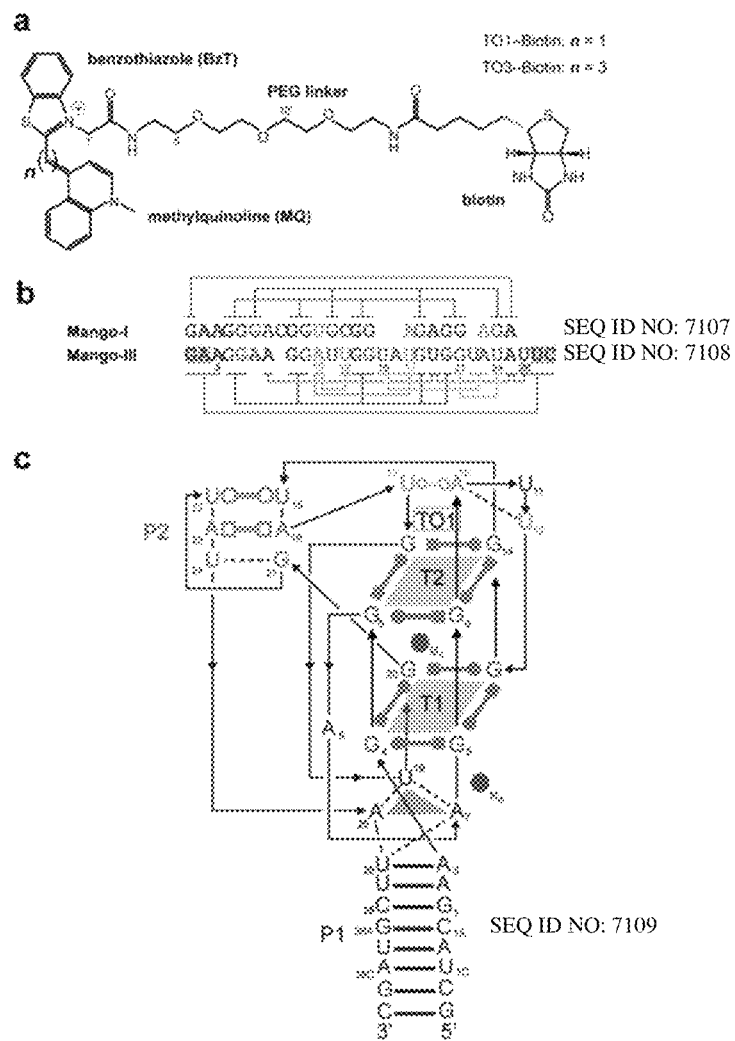
Figures 46A-C

| Aptmt. | Sequence | | $K_d$-TO1B (nM) | TO1B Brightness (Relative) | $K_d$-TO3B (nM) | TO3B Brightness (Relative) |
|---|---|---|---|---|---|---|
| Mango III-A15U | GGCACGUACGAARGAAGGUAGGUAAGGUAUAGUCGUACGGGC | SEQ ID NO: 7117 | 1.0 ± 0.8 | 1.17 ± 0.02 | 170 ± 20 | 0.06 ± 0.02 |
| Mango III-WT | GGCACGUACGAARGAAGGUAGGUAAGGUAUAGUCGUACGGGC | SEQ ID NO: 7118 | 1.0 ± 0.8 | 1.00 ± 0.02 | 92 ± 9 | 1.00 ± 0.03 |
| Mango III-A15G-U23A | GGCACGUACGAARGAAGGUAGGUAAGGUAUAGUCGUACGGGC | SEQ ID NO: 7119 | 34 ± 1 | 0.78 ± 0.02 | 22 ± 17 | 1.31 ± 0.17 |
| Mango III-U23A | GGCACGUACGAARGAAGGUAGGUAAGGUAUAGUCGUACGGGC | SEQ ID NO: 7120 | 28 ± 1 | 0.81 ± 0.03 | 82 ± 9 | 0.98 ± 0.03 |
| Mango III-A15G | GGCACGUACGAARGAAGGUAGGUAAGGUAUAGUCGUACGGGC | SEQ ID NO: 7121 | 14 ± 1 | 0.88 ± 0.03 | 160 ± 20 | 0.75 ± 0.03 |
| Mango III-A15G-U23G | GGCACGUACGAARGAAGGUAGGUAAGGUAUAGUCGUACGGGC | SEQ ID NO: 7122 | 87 ± 4 | 0.87 ± 0.01 | 180 ± 20 | 0.67 ± 0.03 |
| Mango III-U23G | GGCACGUACGAARGAAGGUAGGUAAGGUAUAGUCGUACGGGC | SEQ ID NO: 7123 | 1000 ± 3 | 0.41 ± 0.03 | 1100 ± 900 | 0.36 ± 0.03 |
| Mango III-U23C | GGCACGUACGAARGAAGGUAGGUAAGGUAUAGUCGUACGGGC | SEQ ID NO: 7124 | 170 ± 9 | 0.34 ± 0.02 | 810 ± 400 | 0.6 ± 0.08 |
| Mango III-A15G-U23C | GGCACGUACGAARGAAGGUAGGUAAGGUAUAGUCGUACGGGC | SEQ ID NO: 7125 | 640 ± 80 | 0.26 ± 0.04 | ND | 0.06 ± 0.02 |
| Mango III-A15C-U23A | GGCACGUACGAARGAAGGUAGGUAAGGUAUAGUCGUACGGGC | SEQ ID NO: 7126 | 950 ± 10 | 0.26 ± 0.01 | 420 ± 20 | 0.42 ± 0.03 |
| Mango III-A15C | GGCACGUACGAARGAAGGUAGGUAAGGUAUAGUCGUACGGGC | SEQ ID NO: 7127 | 500 ± 30 | 0.29 ± 0.01 | ND | 0.08 ± 0.02 |
| Mango III-A15C-U23G | GGCACGUACGAARGAAGGUAGGUAAGGUAUAGUCGUACGGGC | SEQ ID NO: 7128 | 530 ± 400 | 0.14 ± 0.01 | 3600 ± 3000 | 0.22 ± 0.03 |
| Mango III-A15C | GGCACGUACGAARGAAGGUAGGUAAGGUAUAGUCGUACGGGC | SEQ ID NO: 7129 | 1600 ± 200 | 0.19 ± 0.01 | ND | 0.08 ± 0.02 |
| Mango III-A15G-U23C | GGCACGUACGAARGAAGGUAGGUAAGGUAUAGUCGUACGGGC | SEQ ID NO: 7130 | 1700 ± 300 | 0.08 ± 0.01 | ND | 0.08 ± 0.02 |
| Mango III-A15G-U23A | GGCACGUACGAARGAAGGUAGGUAAGGUAUAGUCGUACGGGC | SEQ ID NO: 7131 | 4400 ± 300 | 0.06 ± 0.01 | 170 ± 110 | 0.11 ± 0.03 |
| Mango III-A15G-U23G | GGCACGUACGAARGAAGGUAGGUAAGGUAUAGUCGUACGGGC | SEQ ID NO: 7132 | 2000 ± 600 | 0.04 ± 0.01 | 270 ± 180 | 0.13 ± 0.02 |

Figure 52

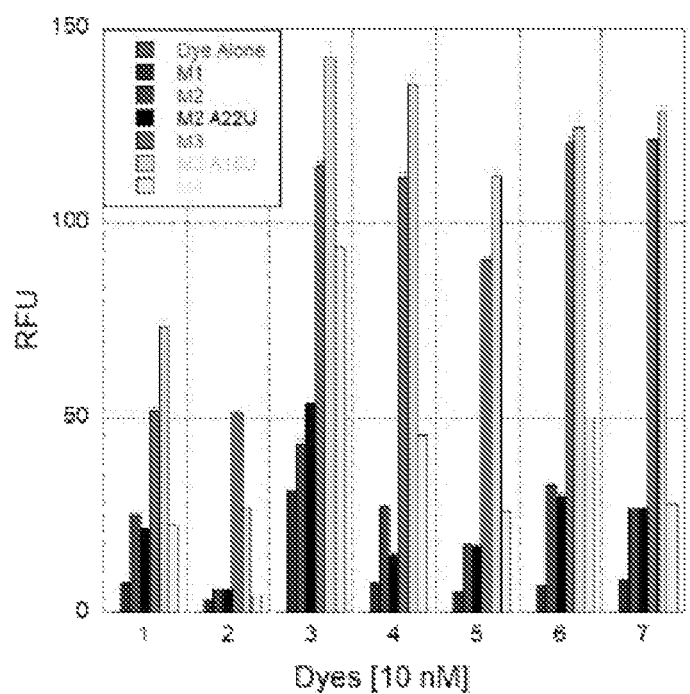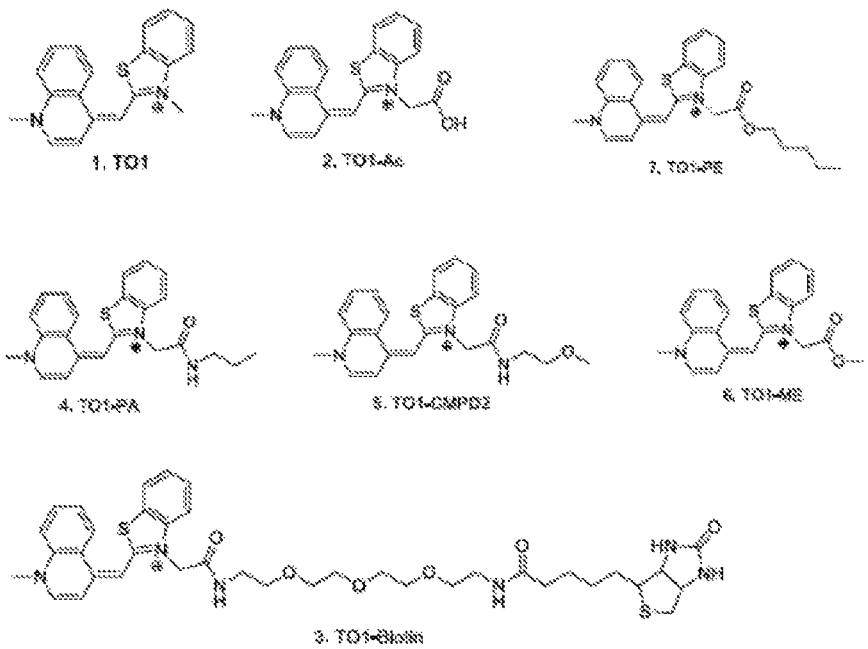
Figure 53

FLUOROGEN-BINDING RNA APTAMERS

FIELD

The invention is in the field of nucleic acid biochemistry, providing RNA aptamers that bind heterocyclic fluorophores, adapted for use in measuring or testing processes that include fluorogenic hybridization assays.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 7551601100_SL.txt. The text file is about 1,362 KB, was created on Mar. 26, 2021, and is being submitted electronically via EFS Web.

BACKGROUND

RNA plays many important roles in cellular biology. However, directly imaging biologically important RNAs has been hindered by a lack of fluorescent tools equivalent to the fluorescent proteins available to study cellular proteins. Preferably, RNA labelling systems should preserve biological function, have photophysical properties similar to existing fluorescent proteins, and be compatible with established live and fixed cell protein labelling strategies.

Since their creation, fluorogenic RNA aptamers that enhance the fluorescence of an unbound fluorophore have sparked significant interest and hold great potential, for example to enable the visualization of RNA molecules within a cell. However, their application has in some cases been limited due to their inability to fold into a correct tertiary structure that simultaneously binds a target fluorophore tightly and in an orientation that maximizes fluorescence (Dolgosheina, E. V. and Unrau, P. J. (2016), Fluorophore-binding RNA aptamers and their applications. WIREs RNA, 7: 843-851). Optimization of both fluorophore binding and bound complex brightness is desirable for fluorescent RNA imaging tags, particularly for the study of cellular RNAs.

SUMMARY

Aptamers are disclosed with distinct fluorescent properties, fluorophore binding affinities, and salt dependence, with specific embodiments designated herein Mango-II, III and IV. Also disclosed are corresponding fluorophores, with selected fluorophores evidencing high cellular permeability. The aptamer's high fluorophore affinities, the high brightness of the bound complexes, and their thermal and salt stability, provide distinct aspects of the disclosed aptamers. The aptamers may accordingly be adapted to work with existing microscope methodologies optimized for the study of proteins. Aspects of the present innovation accordingly involve the use of the disclosed aptamers to study RNA function and dynamics both in vitro and in vivo. Exemplified embodiments have been used for imaging RNA molecules in fixed and live mammalian cells. In particular, the examples herein illustrate that the disclosed aptamers can accurately image the sub-cellular localization of two small non-coding RNAs (5S and U6) in both fixed and live cells. Selected aptamers are shown herein to be as bright or brighter than enhanced GFP when bound to TO1-Biotin.

INVENTION

The invention relates to a RNA aptamer comprising an active core sequence as set forth in:

(SEQ ID NO: 2)
5'- GG@($T_1$/WGW)GG(#$_1$H/WG)WGGN@(#$_2$/-)G($T_2$/H)GNH
(AN@$T_3$/G)-3' with the proviso that the active core sequence is not the sequence as set forth in SEQ ID NO: 1: GAAGGGACG-GUGCGGAGAGGAGA.
wherein, within the active core sequence
 represents no nucleotide (gap);
K represents U or G;
S represents C or G;
R represents A or G;
W represents A or U;
H represents A, C or U;
N represents A, C, G or U; and
@ represents N or no nucleotide;
wherein /, between the brackets ( ) represents an alternative;
and wherein $T_1$ represents any nucleotide, $T_2$ and $T_3$ being defined as follows:
when $T_1$ is A, $T_2$ can be either A, G or U; and
 when $T_1$ is A and $T_2$ is A, then $T_3$ is U;
 when $T_1$ is A and $T_2$ is G, then $T_3$ is U; and
 when $T_1$ is A and $T_2$ is U, then $T_3$ is A or U; or
when $T_1$ is C, $T_2$ can be either G or U; and
 when $T_1$ is C and $T_2$ is G, then $T_3$ is C or G; and
 when $T_1$ is C and $T_2$ is U, then $T_3$ is G; or
When $T_1$ is G, $T_2$ can be either G or C, and $T_3$ is C; or
When $T_1$ is U, $T_2$ can be either A or C; and
 when $T_1$ is U and $T_2$ is A, then $T_3$ is A or U; and
 when $T_1$ is U and $T_2$ is C, then $T_3$ is A;
wherein #$_1$ and #$_2$ represents any nucleotide pair such that
 when #$_1$ is A, then #$_2$ represents A, C, G or U; or
 when #$_1$ is C, then #$_2$ is C; or
 When #$_1$ is G, then #$_2$ is G; or
 when #$_1$ is U, then #$_2$ represents A, G or U.
wherein #$_1$ and #$_2$ represents any nucleotide pair such that
 when #$_1$ is A, then #$_2$ represents A, C, G or U; or
 when #$_1$ is C, then #$_2$ is C; or
 When #$_1$ is G, then #$_2$ is G; or
 when #$_1$ is U, then #$_2$ represents A, G or U.
wherein the aptamer adopts a determined tridimensional conformation which is a fluorophore binding conformation, said aptamer when it adopts the fluorophore binding conformation being liable to interact with a fluorophore; wherein the aptamer further comprises, contiguous with the active core sequence, a 5' leader sequence attached, or operably linked to (by covalent bound, i.e. phosphodiester bound), to the 5' terminus of the active core and a 3' tail sequence attached, or operably linked to (by covalent bridge mentioned below), to the 3' terminus of the active core, wherein the 5' leader sequence and the 3' tail sequence together mediate the juxtaposition of the 5' terminus of the active core and the 3' terminus of the active core when the aptamer is the fluorophore binding conformation.

The invention is based on the identification by the inventors of nucleic acid molecules having a determined structure that adopts a specific conformation (binding conformation)

to interact with fluorophore compounds to form a fluorophore-aptamer complex. When the interaction occurs, the fluorescence of the fluorophore significantly increases compared to the fluorescence of the fluorophore that does not form a complex with the aptamer complex.

Advantageously, the sequence of the aptamer as defined above encompasses the two following sequences

```
                                            (SEQ ID NO: 3)
5'- GG@(T1)GG(#1H)WGGN@ (#2)G(T2)GNH(AN@T3)-3';
and (SEQ ID NO: 4)
5'- GG@(WGW)GG(WG)WGGN@G(H)GNH(G)-3'.
```

The aptamer, in its binding conformation, forms a G-quadruplex and appears like an hairpin.

Advantageously, the invention relates to the aptamer as defined above, wherein said aptamer can interact with a fluorophore, said fluorophore being selected from a group consisting of the following compounds of the following Formula I and Formula II:

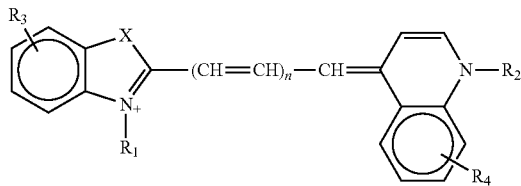

(I)

wherein:
X represents 0, S, Se, or $C(CH_3)_n$;
$R_1$ represents an alkyl having from 1-6 carbons;
$R_2$ represents an alkyl having from 1-6 carbons;
$R_3$ is either a fused benzene, an alkyl having 1-6 carbons, a methoxy or H;
$R_4$ is an alkyl having 1-6 carbons, a methoxy or H; and
n=zero or an integer from 1-6;

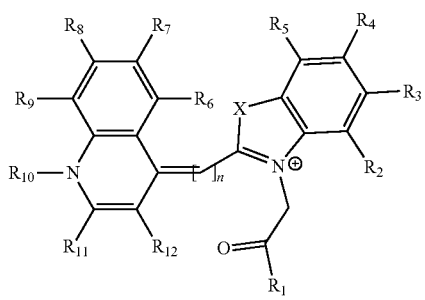

(II)

wherein:
$R_1$ represents any substituent;
$R_2$ through $R_5$ represent H, F, Cl, Br, I, $CH_3$, linear polymers, or extended heterocycles
$R_6$-$R_9$ represent H, F, Cl, Br, I, $CH_3$, linear polymers, or extended heterocycles
$R_{10}$ represents H, F, Cl, Br, I, $CH_3$, linear polymers, or extended heterocycles.
$R_{11}$ through $R_{12}$ represent H, F, Cl, Br, I, $CH_3$, linear polymers, or extended heterocycles
X represents the following atoms O, S and Se; and
n is 1 or 3 or 5.

Advantageously, the RNA aptamer as defined above has a fluorophore binding affinity of at least 0.5 µM when the active core is in a fluorophore binding conformation.

More advantageously, the binding of the fluorophore of formula I or II by the RNA aptamer, as defined above, in the fluorophore binding conformation, increases the fluorescence of the fluorophore of formula I or II, and the fluorophore-aptamer complex has a brightness of at least 5,000 $M^{-1}$ $cm^{-1}$.

Advantageously, the invention relates to the RNA aptamer as defined above, wherein the fluorophore complex has a brightness of at least 6,000, or at least 7,000, or at least 8,000, or at least 9,000, or at least 10,000, or at least 11,000 $cm^1$.

Advantageously, the invention relates to the RNA aptamer as defined above, wherein the core active sequence comprises the following sequence:

```
                                            (SEQ ID NO: 5)
5'-$1GGNT1GG#1HUGGHA#2GT2GNHAN@T3$2-3'
``` wherein:
H represents A, C or U
N represents A, C, G or U
@ represents any nucleotide or no nucleotide
$\#_1$ and $\#_2$ represents any nucleotide pair such that
    when $\#_1$ is A, then $\#_2$ represents A, C, G or U; or
    when $\#_1$ is C, then $\#_2$ is C; or
    When $\#_1$ is G, then $\#_2$ is G; or
    when $\#_1$ is U, then $\#_2$ represents A, G or U.
$\$_1$ and $\$_2$ represent any pair of nucleotides such that
    when $\$_1$ is A, then $\$_2$ is A, G or U; or
    when $\$_1$ is C, then $\$_2$ is A, G or U; or
    when $\$_1$ is G, then $\$_2$ is A, C, G or U; or
    when $\$_1$ is U, then $\$_2$ is A, G.
wherein the 5' and 3' external sequence forms a helix that is substantially base paired.

Advantageously, the invention relates to The RNA aptamer defined above, wherein the core active sequence comprises the following sequence:

```
                                            (SEQ ID NO: 6)
GG@WGWGGWGWGGN@GHGGHG
``` wherein:
W represents A or U;
H represents A, C or U;
N represents A, C, G or U; and
@ represents N or no nucleotide.

Advantageously, the invention relates to the RNA aptamer as defined above, wherein the core active sequence comprises the following sequence:

```
                                            (SEQ ID NO: 7)
GAA(GG)1AA(GG)2NUU(GG)3UAN'G4iUG4iiGUAUAUUC
``` wherein:
N is any nucleotide, N' the anti-watson crick partner to N wherein $(GG)_1$, $(GG)_2$, $(GG)_3$ and $G_{4i}$ and $G_{4ii}$ form a quadruplex structure when the active core is in the fluorophore binding conformation, with the 5' terminus of the active core being juxtaposed to the 3' terminus of the active core.

Advantageously, the invention relates to the RNA aptamer as defined above, wherein the core active sequence comprises the following sequence:

(SEQ ID NO: 8)
[G/C]NR(GG)$_1$[R/D]AG[A/U](GG)$_2$NGN(GG)$_3$A*[A/U/D]GA*

(GG)$_4$[A/C]R[A/D]

wherein:
A* is A or N,
N is any nucleotide
R is a purine,
D denotes the absence of nucleotide,
wherein (GG)$_1$, (GG)$_2$, (GG)$_3$ and (GG)$_4$ form a quadruplex structure when the active core is in the fluorophore binding conformation, with the 5' terminus of the active core being juxtaposed to the 3' terminus of the active core.

More advantageously, the invention relates to the RNA aptamer as defined above, wherein the core active sequences comprises one of the sequences as set forth in SEQ ID NO: 9 to SEQ ID NO: 6829, preferably as set forth in SEQ ID NO: 9 to SEQ ID NO: 6887.

In another advantageous embodiment, the aptamer according to the invention comprises or consists essentially of or consists of one of the sequences as set forth in SEQ ID NO: 6830 to SEQ ID NO: 6875 (Mango III) or as set forth in SEQ ID NO: 6876 to SEQ ID NO: 6887 (Mango II).

Advantageously, the invention relates to the RNA aptamer comprising a core active sequence as defined above, with the proviso that said aptamer active core does not have the core sequence: GNR(GG)$_1$GNN(GG)$_2$NGN(GG)$_3$AGN(GG)$_4$AGA SEQ ID NO 6888, wherein R is a purine, and N is any nucleotide.

Advantageously, the invention relates to the RNA aptamer according to the above definition, wherein the 5' leader sequence and the 3' tail sequence are complementary, so that binding of the 5' leader sequence to the 3' tail sequence mediates the juxtaposition of the 5' terminus of the active core and the 3' terminus of the active core when the aptamer is the fluorophore binding conformation.

More advantageously, the invention relates to the RNA aptamer according to the above definition, wherein the 5' leader sequence and the 3' tail sequence are complementary to a target sequence, the target sequence comprising:
a leader bait sequence that is complementary to the 3' tail sequence of the aptamer; and
a tail bait sequence that is complementary to the 5' leader sequence of the aptamer;
the leader and tail bait sequences being juxtaposed in the target sequence, so that binding of:
binding of the 3' tail sequence to the 5' leader bait sequence; mediates the juxtaposition of the 5' terminus of the active core and the 3' terminus of the active core when the aptamer is in the fluorophore binding conformation.

More advantageously, the invention relates to the RNA aptamer as defined above, wherein the leader and tail bait sequences being contiguous in the target sequence.

More advantageously, the invention relates to the RNA aptamer according to the above definition, wherein juxtaposition of the 5' terminus of the active core and the 3' terminus of the active core when the aptamer is the fluorophore binding conformation brings a phosphate group from the 5' terminus to within 10 Å, or to within 9 Å or to within 8 Å, of a phosphate group from the 3' terminus.

More advantageously, the invention relates to the RNA aptamer according to the above definition, wherein the aptamer has a fluorophore binding affinity of at least 400 nM, 300 nM, 200 nM, 100 nM, 50 nM, 40 nM, 30 nM, 20 nM, 10 nM, 5 nM, 1 nM or 0.5 nM when the core is in a fluorophore binding conformation. More advantageously, the invention relates to the RNA aptamer according to the above definition, wherein the fluorophore-aptamer complex has a brightness of at least 7,000 M$^{-1}$cm$^{-1}$, 8,000 M$^{-1}$cm$^{-1}$, 9,000 M$^{-1}$ cm$^{-1}$, 10,000 M$^{-1}$ cm$^{-1}$, or 43,000 M$^{-1}$cm$^{-1}$.

More advantageously, the invention relates to the RNA aptamer according to the above definition, wherein the fluorophore-aptamer complex has a fluorescent lifetime of at least 1 ns, or at least 2 ns, or at least 3 ns, or at least 4 ns or at least 5 ns, or at least 6 ns, or in the range of 1-6 ns, i.e. 1, or 2, or 3 or 4, or 6 or 6 ns.

More advantageously, the invention relates to the RNA aptamer according to the above definition, wherein the fluorophore-aptamer complex is fluorescent in a formaldehyde solution.

In another advantageous embodiment, the invention relates to the RNA aptamer according to the above definition, wherein the secondary aptamer sequence has affinity for a secondary target moiety.

The invention also relates to an RNA aptamer comprising an active core sequence, wherein the aptamer has a fluorophore binding affinity of at least 0.5 μM when the active core is in a fluorophore binding conformation, wherein the active core has a 5' terminus and a 3' terminus, and wherein the active core sequence from the 5' terminus to the 3' terminus is one of:
Active Core I:

(SEQ ID NO: 8)
[G/C]NR(GG)$_1${RAGU/AG[A/U]/GNN}(GG)$_2$NGN(GG)$_3$A*

[A/U/D]GA*(GG)$_4$[A/C]R[A/D]

wherein within the { } the first two blocks are optionally RRG[A/U] or Active Core II (SEQ ID NO: 7)
GAA(GG)$_1$AA(GG)$_2$AUU(GG)$_3$UAUGU(GG)$_4$UAUAUUC wherein:
A* is A or N,
N is any nucleotide,
R is a purine,
D denotes the absence of a residue,
wherein G$_1$, G$_2$, G$_3$ and G$_4$ form a quadruplex structure when the active core is in the fluorophore binding conformation, with the 5' terminus of the active core being juxtaposed to the 3' terminus of the active core; and,
wherein the fluorophore is a compound of Formula I or Formula II

I

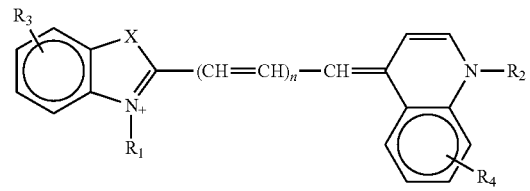

-continued

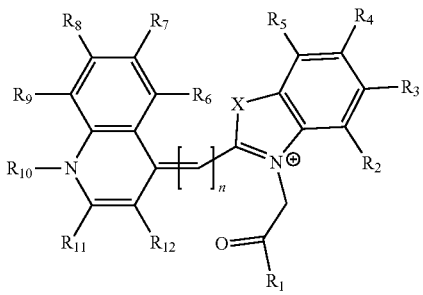

wherein substituents in Formula I are defined as follows:
X=O, S, Se, or C(CH$_3$)$_n$;
=alkyl having from 1-6 carbons;
R$_2$=alkyl having from 1-6 carbons;
R$_3$=fused benzene, alkyl having 1-6 carbons, methoxy or H;
R$_4$=alkyl having 1-6 carbons, methoxy or H; and
n=zero or an integer from 1-6.
wherein substituents in Formula II are defined as follows:

| | |
|---|---|
| R$_1$ | Any substituent |
| R$_2$ through R$_5$ | H, F, Cl, Br, I, CH$_3$, linear polymers, or extended heterocycles |
| R$_6$-R$_9$ | H, F, Cl, Br, I, CH$_3$, linear polymers, or extended heterocycles |
| R$_{10}$ | H, F, Cl, Br, I, CH$_3$, linear polymers, or extended heterocycles. |
| R$_{11}$ through R$_{12}$ | H, F, Cl, Br, I, CH$_3$, linear polymers, or extended heterocycles |
| X atoms | O, S, Se |
| n | 1 or 3 or 5 | wherein binding of the fluorophore by the aptamer in the fluorophore binding conformation increases the fluorescence of the fluorophore, and the fluorophore-aptamer complex has a brightness of at least 12,000 M$^{-1}$cm$^{-1}$;

wherein the aptamer further comprises, contiguous with the active core sequence, a 5' leader sequence attached to the 5' terminus of the active core and a 3' tail sequence attached to the 3' terminus of the active core, wherein the 5' leader sequence and the 3' tail sequence together mediate the juxtaposition of the 5' terminus of the active core and the 3' terminus of the active core when the aptamer is the fluorophore binding conformation.

The invention also relates to an RNA aptamer comprising an active core sequence, wherein the aptamer has a fluorophore binding affinity of at least 0.5 µM when the active core is in a fluorophore binding conformation, wherein the active core has a 5' terminus and a 3' terminus, and wherein the active core sequence from the 5' terminus to the 3' terminus is one of:

Active Core I:

(SEQ ID NO: 8)
[G/C]NR(GG)$_1${RAGU/AG[A/U]/GNN}(GG)$_2$NGN(GG)$_3$A*

[A/U/D]GA*(GG)$_4$[A/C]R[A/D]

wherein within the { } the first two blocks are optionally RRG[A/U] or Active Core II (SEQ ID NO: 7)
GAA(GG)$_1$AA(GG)$_2$AUU(GG)$_3$UAUGU(GG)$_4$UAUAUUC wherein:
A* is A or N,
N is any nucleotide,
R is a purine,
D denotes the absence of a residue,
wherein (GG)$_1$, (GG)$_2$, (GG)$_3$ and (GG)$_4$ form a quadruplex structure when the active core is in the fluorophore binding conformation, with the 5' terminus of the active core being juxtaposed to the 3' terminus of the active core; and,
wherein the fluorophore is a compound of Formula I or Formula II

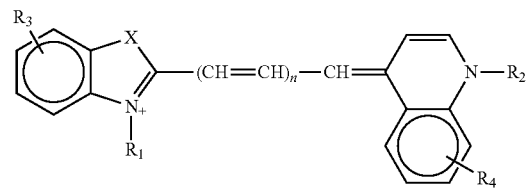

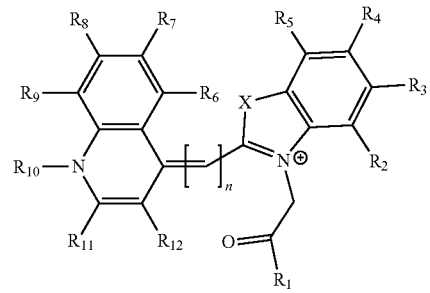

wherein substituents in Formula I are defined as follows:
X=O, S, Se, or C(CH$_3$)$_n$;
R$_1$=alkyl having from 1-6 carbons;
R$_2$=alkyl having from 1-6 carbons;
R$_3$=fused benzene, alkyl having 1-6 carbons, methoxy or H;
R$_4$=alkyl having 1-6 carbons, methoxy or H; and
n=zero or an integer from 1-6.
wherein substituents in Formula II are defined as follows:

| | |
|---|---|
| R$_1$ | Any substituent |
| R$_2$ through R$_5$ | H, F, Cl, Br, I, CH$_3$, linear polymers, or extended heterocycles |
| R$_6$-R$_9$ | H, F, Cl, Br, I, CH$_3$, linear polymers, or extended heterocycles |
| R$_{10}$ | H, F, Cl, Br, I, CH$_3$, linear polymers, or extended heterocycles. |
| R$_{11}$ through R$_{12}$ | H, F, Cl, Br, I, CH$_3$, linear polymers, or extended heterocycles |
| X atoms | O, S, Se |
| n | 1 or 3 or 5 | wherein binding of the fluorophore by the aptamer in the fluorophore binding conformation increases the fluorescence of the fluorophore, and the fluorophore-aptamer complex has a brightness of at least 5,000 M$^{-1}$cm$^{-1}$;

wherein the aptamer further comprises, contiguous with the active core sequence, a 5' leader sequence attached to the 5' terminus of the active core and a 3' tail sequence attached to the 3' terminus of the active core, wherein the 5' leader sequence and the 3' tail sequence together mediate the juxtaposition of the 5' terminus of the active core and the 3' terminus of the active core when the aptamer is the fluorophore binding conformation;

wherein the 5' leader sequence and the 3' tail sequence are complementary to a target sequence, the target (bait) sequence comprising:
  a leader bait sequence that is complementary to the 3' tail sequence of the aptamer; and,
  a tail bait sequence that is complementary to the 5' leader sequence of the aptamer;
the leader and tail bait sequences being juxtaposed in the target sequence, so that binding of:
  the 5' leader sequence to the tail bait sequence; combined with, binding of the 3' tail sequence to the leader bait sequence;
  mediates the juxtaposition of the 5' terminus of the active core and the 3' terminus of the active core when the aptamer is the fluorophore binding conformation.

Advantageously, the invention relates to the RNA aptamer as defined above, wherein the 5' leader bait and 3' tail bait sequences are contiguous in the target sequence.

The invention also relates to a molecular complex comprising, or consisting essentially of:
  an RNA aptamer as defined above; and
  a fluorophore selected from group consisting of the following compounds of the following Formula I and Formula II.

More advantageously, the invention relates to the molecular complex as defined above, wherein the fluorophore is chosen from the group consisting of the following compounds, where X=O, S or Se, and n=1, 3, or 5:

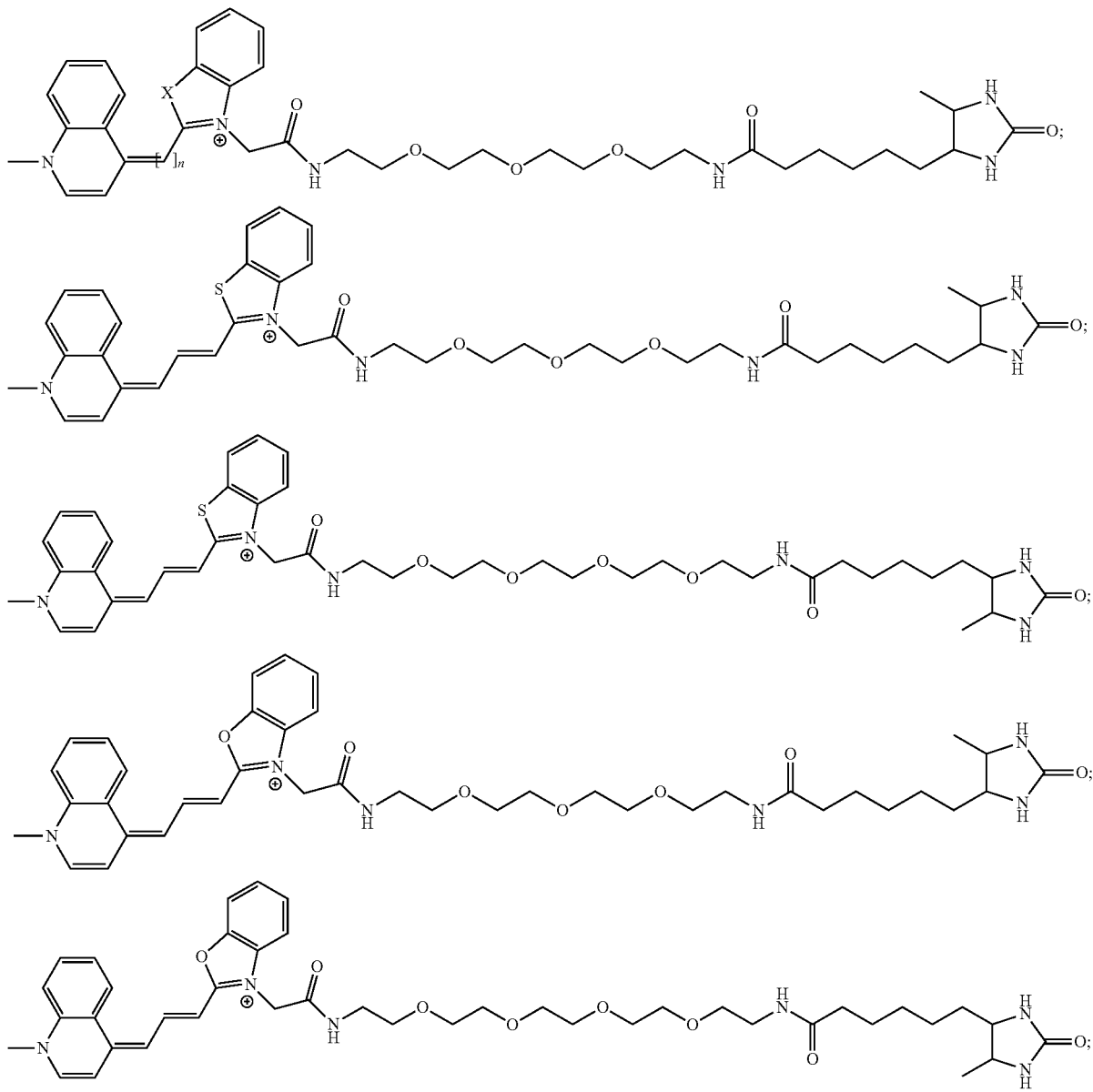

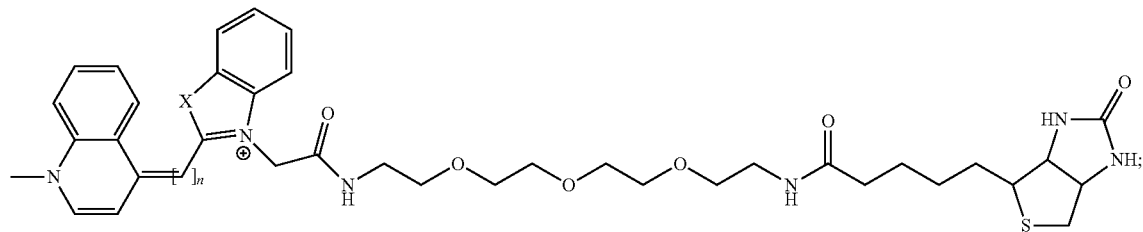
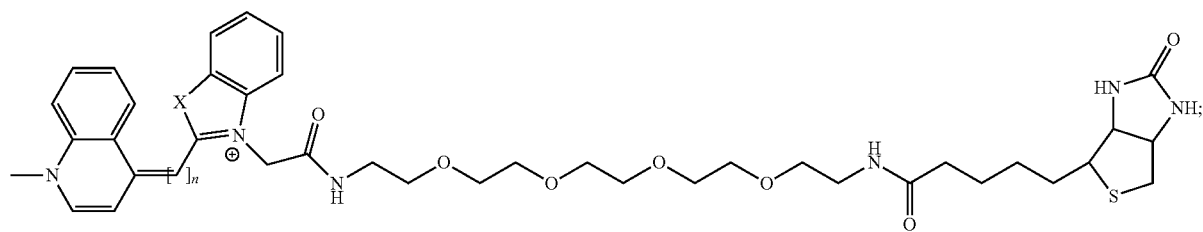
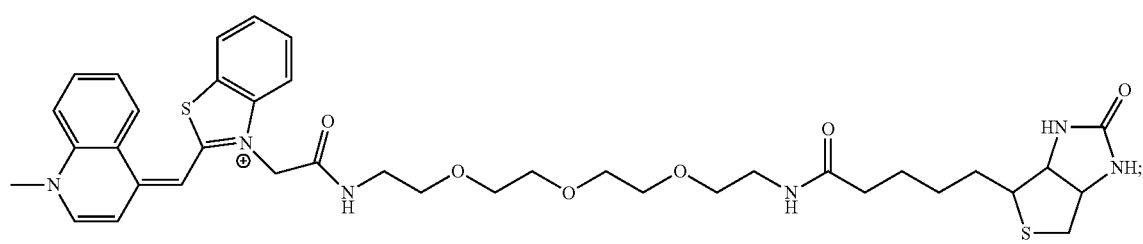
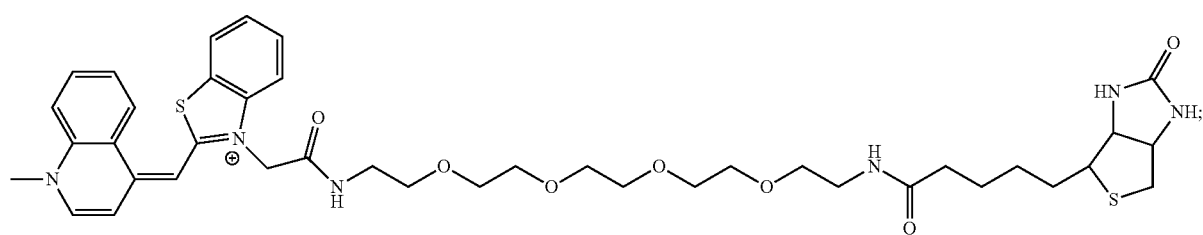
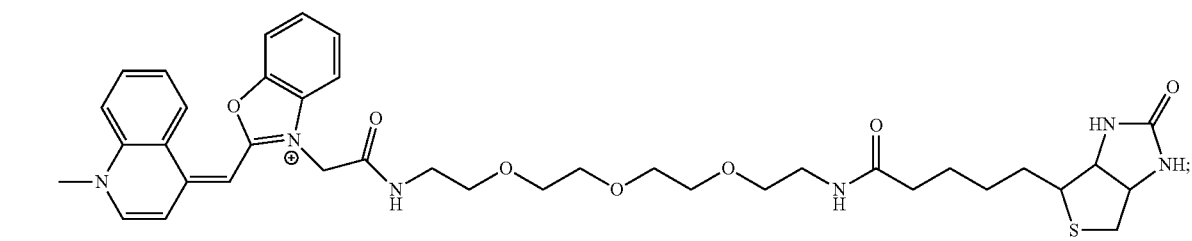
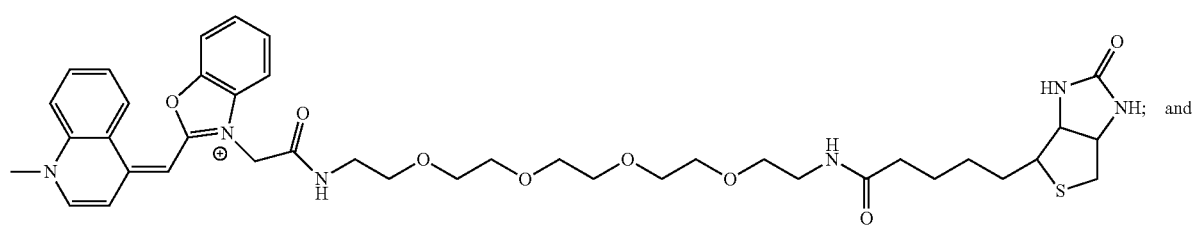

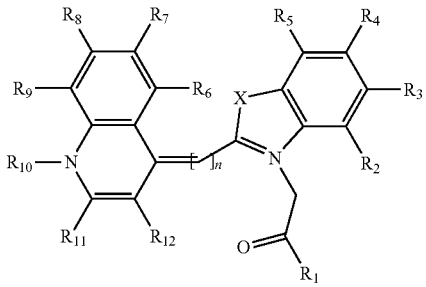

wherein $R_1$ is,

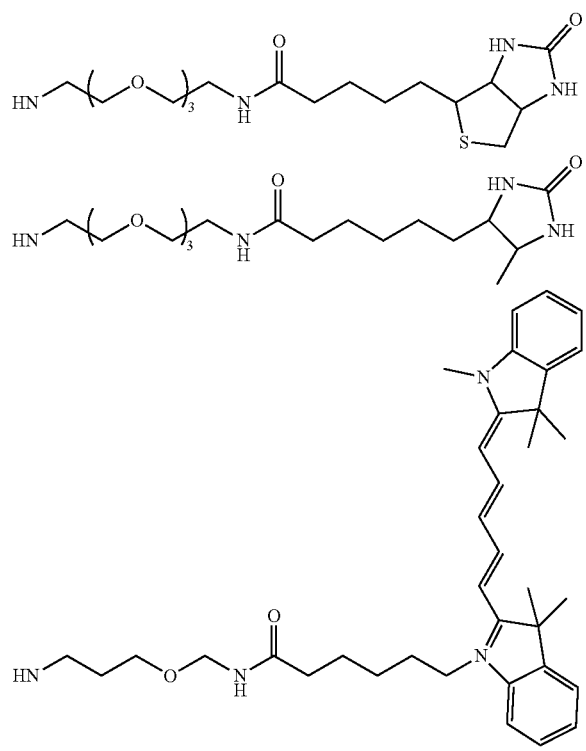

The invention will be better explained in the following figures and examples.

BRIEF DESCRIPTION OF THE DRAWINGS

FIG. 6|Resistance or selectivity of TO1-Biotin binding variants in presence of competitors after each round of screening. (a) NMM resistance selection: Resistance of TO1-Biotin/RNA complexes to NMM. The fluorescence of the complex between TO1-Biotin and the RNAs from the libraries obtained after each round of screening was determined by mixing 2 μM RNA and 100 nM TO1-Biotin in the absence or in the presence of 3 μM NMM. The Resistance to NMM was calculated by normalizing the aptamer/TO1-Biotin fluorescence in the presence of NMM by the aptamer/TO1-Biotin fluorescence in the absence of NMM. (b) TO3-Biotin resistance selection: Resistance of TO1-Biotin/RNA complexes to TO3-Biotin. The fluorescence of the complex between TO1-Biotin and the RNAs from the libraries obtained after each round of screening was determined by mixing 300 nM RNA and 100 nM TO1-Biotin, in the absence or in the presence of 1.6 μM TO3-Biotin. The resistance to TO3-Biotin was calculated by normalizing the aptamer/TO1-Biotin fluorescence in the presence of TO3-Biotin by the aptamer/TO1-Biotin fluorescence in the absence of TO3-Biotin. (c) Selectivity of the libraries obtained after the different rounds of screening in the presence of TO3-Biotin. The green fluorescence of the TO1-Biotin/RNA complex was normalized to the red fluorescence of the TO3-Biotin/RNA complex to calculate the selectivity index. The blue bar indicates the concentration of competitor used during the screening step. Data was obtained at 25° C., the values are the mean of three independent experiments and error bars correspond to ±1 standard error.

FIG. 7|Analysis of the clones obtained at the end of the screening process performed in the presence of NMM. (a) Brightness of the complexes formed between TO1-Biotin and individual variants isolated from the screenings in the presence of NMM. Aptamer-coding genes were PCR amplified, in vitro transcribed in the presence of TO1-Biotin and the fluorescence was monitored at 37° C. The maximal fluorescence was normalized to that of Mango I. (b) Resistance of TO1-Biotin/RNA complex to NMM. TO1-Biotin fluorescence was monitored as in (a) in the absence or in the presence of 3 μM NMM. (c) Sequence analysis of the clones of interest. The sequences of the clones of interest (indicated by an asterisk in a and b) were aligned with Clustal X. The green boxes indicate Mango III (R5-NMM-20) and Mango IV (R5-NMM-5).

FIG. 9|Mutations and truncations of Mangos-II, III and IV. (a) Mango II constructs. (b) Mango IV constructs. (c) Mango III constructs. $F_E$ is relative to the full-length construct, which was normalized to one. Constructs with binding affinities higher than the end point of titration are labeled 'u.d.' (undeterminable). The closing stem regions are highlighted in purple. Guanine residues protected from DMS cleavage in the named Mango constructs of the study (FIG. 2d) are highlighted in yellow.

TABLE 1

| Hill coefficients of RNA Mango/TO1-Biotin complexes | | | | |
|---|---|---|---|---|
| | Hill Coefficients | | $K_D$ (mM) | |
| | $K^+$ | $Na^+$ | $K^+$ | $Na^+$ |
| Mango-I | 1.2 ± 0.1 | N/A | 48 ± 5 | N/D |
| Mango-II | 1.4 ± 0.2 | 0.8 ± 0.1 | 39 ± 10 | 170 ± 110 |
| Mango-III | 1.0 ± 0.8* | 0.5 ± 0.5 | 0.4 ± 0.1 | 0.8 ± 0.3 |
| Mango-IV | 1.5 ± 0.2* | N/A | 64 ± 24 | N/D |

Errors are the standard deviation of three independent measurements.
*Hill coefficients with an asterisk are estimated based on initial rise of fluorescence data.

Figure 11:
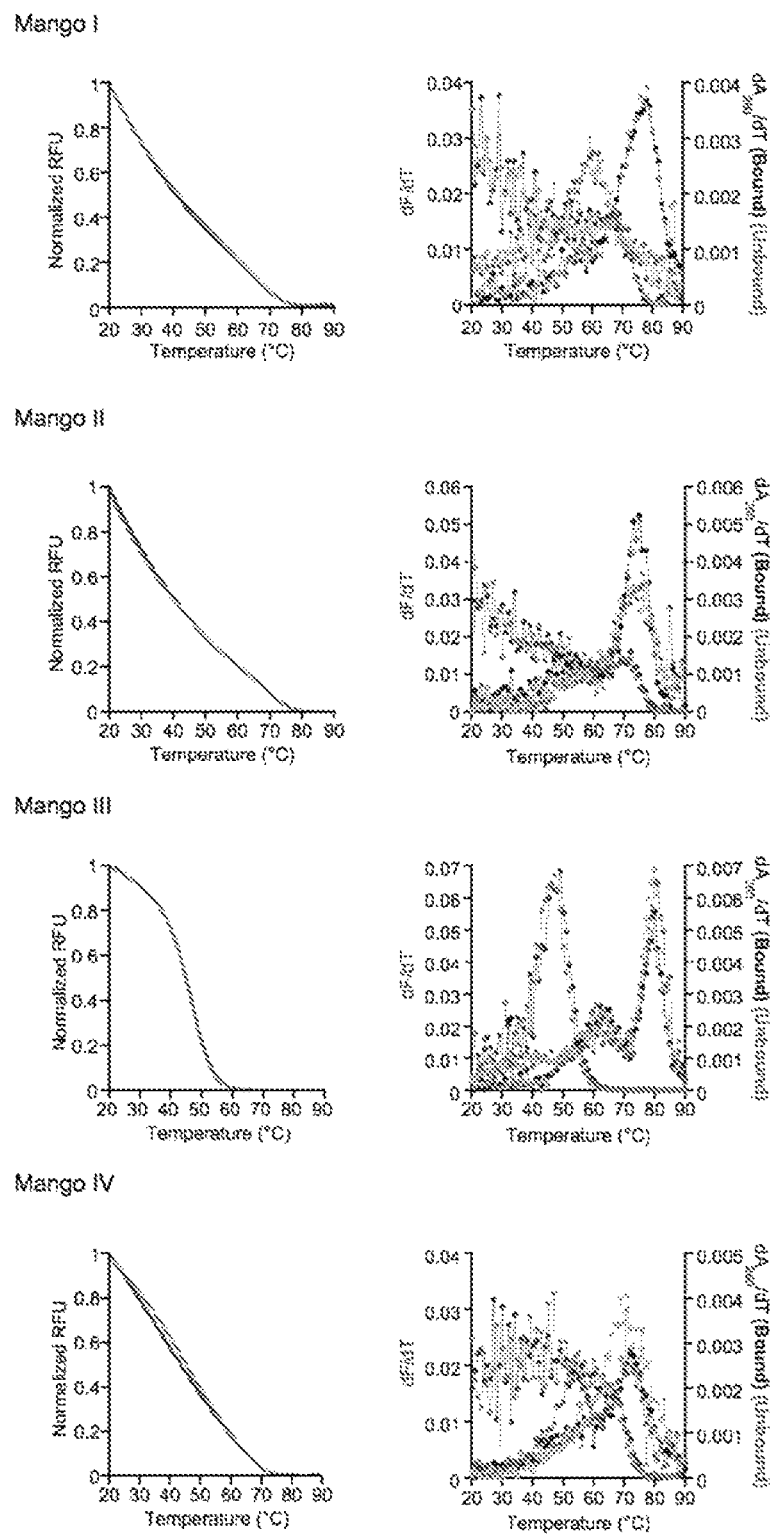

FIG. 11|Temperature-dependent fluorescent and UV absorbance spectroscopy of new Mango variants. Line plots of temperature-dependent spectroscopy for Mango I (data obtained from previous work)[1], Mango II, Mango III, and Mango IV. Left panels: 1 μM RNA was incubated with 5 μM TO1-Biotin and subjected to temperature ramps while monitoring fluorescence (red shades). Right panels: $A_{260}$ for this sample with 5 μM TO1-Biotin (green shades) and without TO1-Biotin (blue shades) were collected and the simple derivative plotted together with the derivative of the fluorescence data. Starting at 90° C., temperature was ramped down at a rate of 1° C./min to 20° C. (darker shade) and returned to 90° C. at a rate of 1° C./min (lighter shade).

Figure 12:
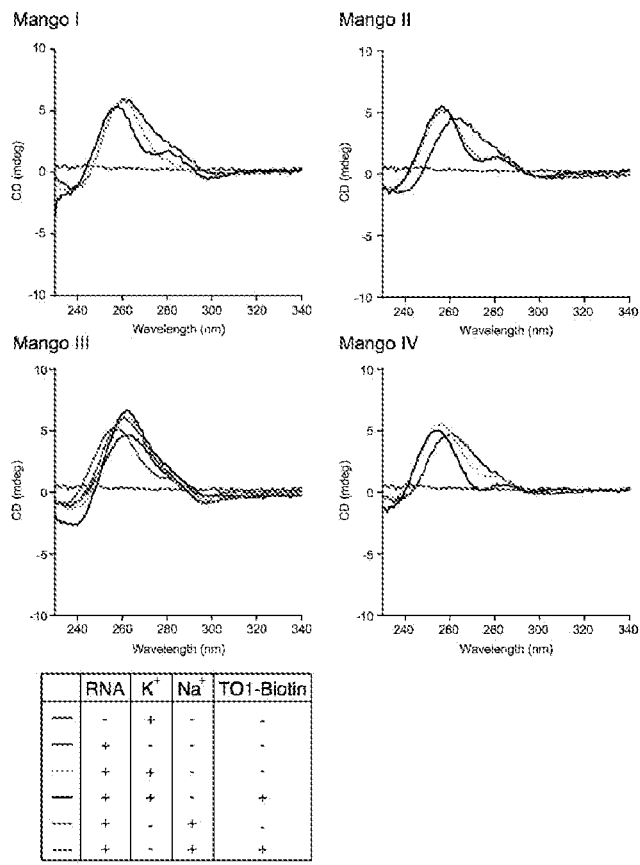

FIG. 12|Circular dichroism spectra. Circular dichroism spectra of Mango I, II, III, and IV. 5 μM RNA was measured in 10 mM Tris pH 7.5 buffer either alone, with 140 mM monovalent salt, and/or with 7 μM TO1-Biotin as indicated by the legend. Data is a line plot to guide the eye.

Figure 13:
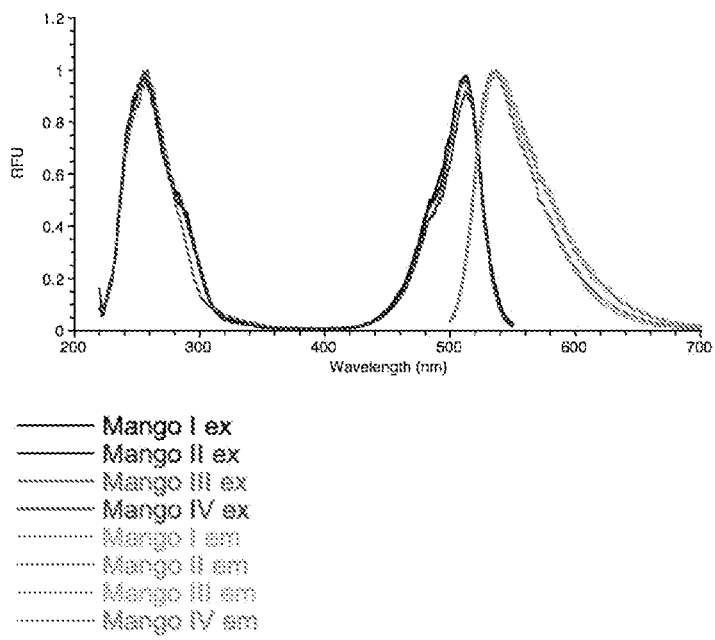

FIG. 13|Photophysics: excitation/emission. (a) Excitation (dark curve) and emission (light curve) spectra of each Mango. All Mangos have $\Delta_{ex}$ max=510 nm and $\Delta_{em}$ max=535 nm. Color-coding is as follows: Black—Mango I, Blue—Mango II, Green—Mango III, Red—Mango IV.

Figure 14:
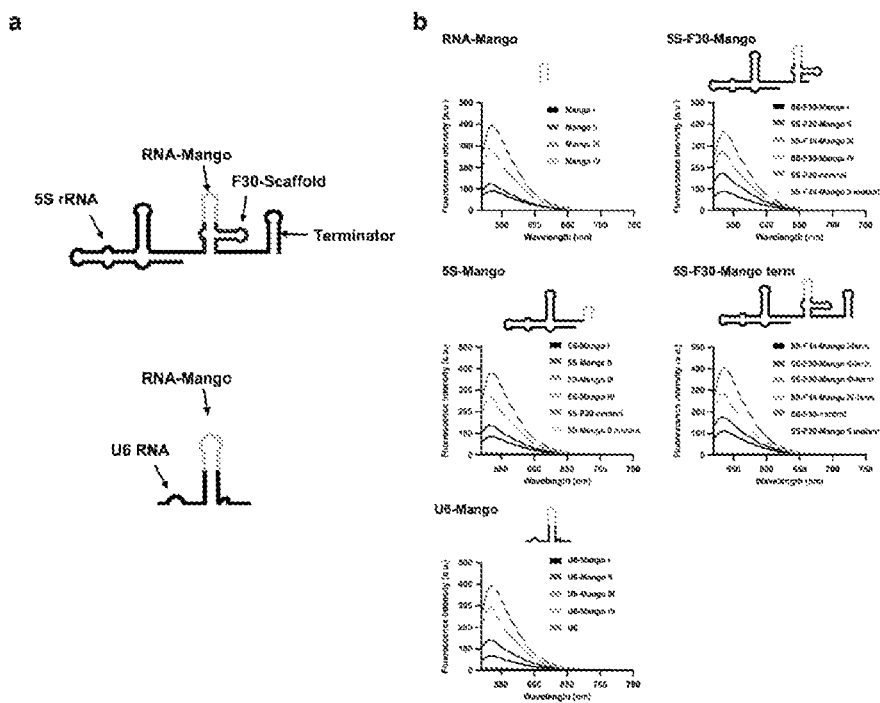

FIG. 14|RNA scaffold diagrams. Diagrams of the 5S-Mango and U6-Mango constructs synthesized (sequences in Table 2) and their fluorescence emission as a function of wavelength after excitation at 505 nm, compared to unmodified Mango I-IV.

TABLE 2

Constructs used in in vivo experiments

| Construct | Sequence | SEQ ID NO: |
|---|---|---|
| 5S-30-Control | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGGAAACCCA CATACTCTGA TGATCCTTCG GGATCATTCA TGGCAATCTA GA | 6889 |
| 5S-F30-Mango II mutant | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGTACGAATT AGATTAGATT AAGATTAGAG TACCCACATA CTCTGATGAT CCTTCGGGAT CATTCATGGC AATCTAGA | 6890 |
| 5S-F30-Mango I | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGTACGAAGG GACGGTGCGG AGAGGAGAGT ACCCACATAC TCTGATGATC CTTCGGGATC ATTCATGGCA ATCTAGA | 6891 |
| 5S-F30-Mango II | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGTACGAAGG AGAGGAGAGG AAGAGGAGAG TACCCACATA CTCTGATGAT CCTTCGGGAT CATTCATGGC AATCTAGA | 6892 |
| 5S-F30-Mango III | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGTACGAAGG AAGGATTGGT ATGTGGTATA TTCGTACCCA CATACTCTGA TGATCCTTCG GGATCATTCA TGGCAATCTA GA | 6893 |
| 5S-F30-Mango IV | GTCTACGGCC ATACCACCCT GAACGCGCCC GATCTCGTCT GATCTCGGAA GCTAAGCAGG GTCGGGCCTG GTTAGTACTT GGATGGGAGA CCGCCTGGGA ATACCGGGTG CTGTAGGCGT CGACTTGCCA TGTGTATGTG GGTACCGAGG GAGTGGTGAG GATGAGGCGA GTACCCACAT ACTCTGATGA TCCTTCGGGA TCATTCATGG CAATCTAGA | 6894 |
| 5S Δ78-98-F30-Mango IV | GTCTACGGCC ATACCACCCT GAACGCGCCC GATCTCGTCT GATCTCGGAA GCTAAGCAGG GTCGGGCCTG GTTAGTAGAA AGAATACCGG GTGCTGTAGG CGTCGACTTG CCATGTGTAT GTGGGTACCG AGGGAGTGGT GAGGATGAGG CGAGTACCCA CATACTCTGA TGATCCTTCG GGATCATTCA TGGCAA | 6895 |
| U6-Mango IV | GTGCTCGCTT CGGCAGCACA TATACTAAAA TTGGAACGAT ACAGAGAAGA TTAGCATGGC CCCTACCGAG GGAGTGGTGA GGATGAGGCG AGTAGGATGA CACGCAAATT CGTGAAGCGT TCCATATTTT T | 6896 |
| 5' SalI F30 primer | GGCGTCGACT TGCCATGTGT ATGTGGGTAC | 6899 |
| 3' XbaI F30 primer | CGCTCTAGAT TGCCATGAAT GATCCCGAAG G | 6897 |
| 5' T7 promoter 5S primer | GCCGGATCCT AATACGACTC ACTATAGTCT ACGGCCATAC CACCC | 6898 |

Figure 15:
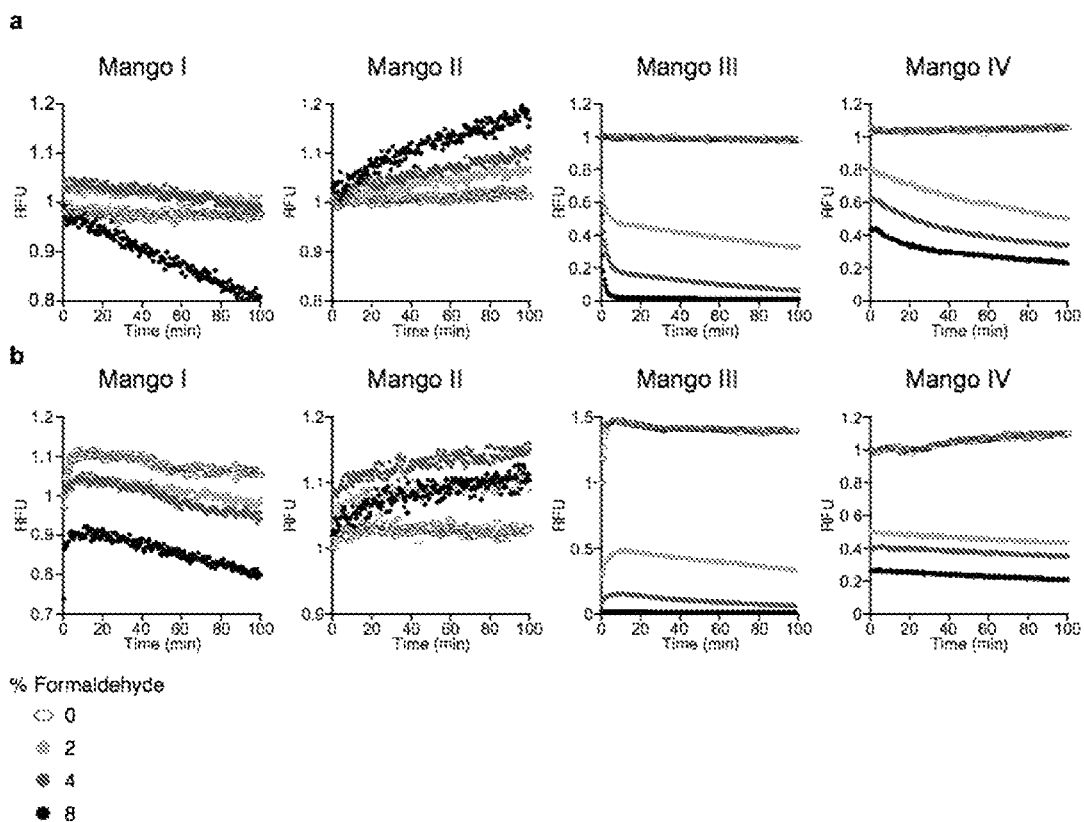

FIG. 15|Effect of formaldehyde on Mango fluorescence. Fluorescence of 50 nM RNA Mango I, II, III, and IV with 100 nM TO1-Biotin are measured at 30 second intervals at 25° C. In (a) RNA is first incubated with TO1-Biotin for one hour before addition of corresponding formaldehyde amounts and fluorescence is measured for another 100 minutes. In (b) RNA is incubated with the corresponding amounts of formaldehyde first for one hour, then TO1-Biotin is added. Data for each panel is normalized to RFU at the 0% formaldehyde, 0 min point.

Figure 16:
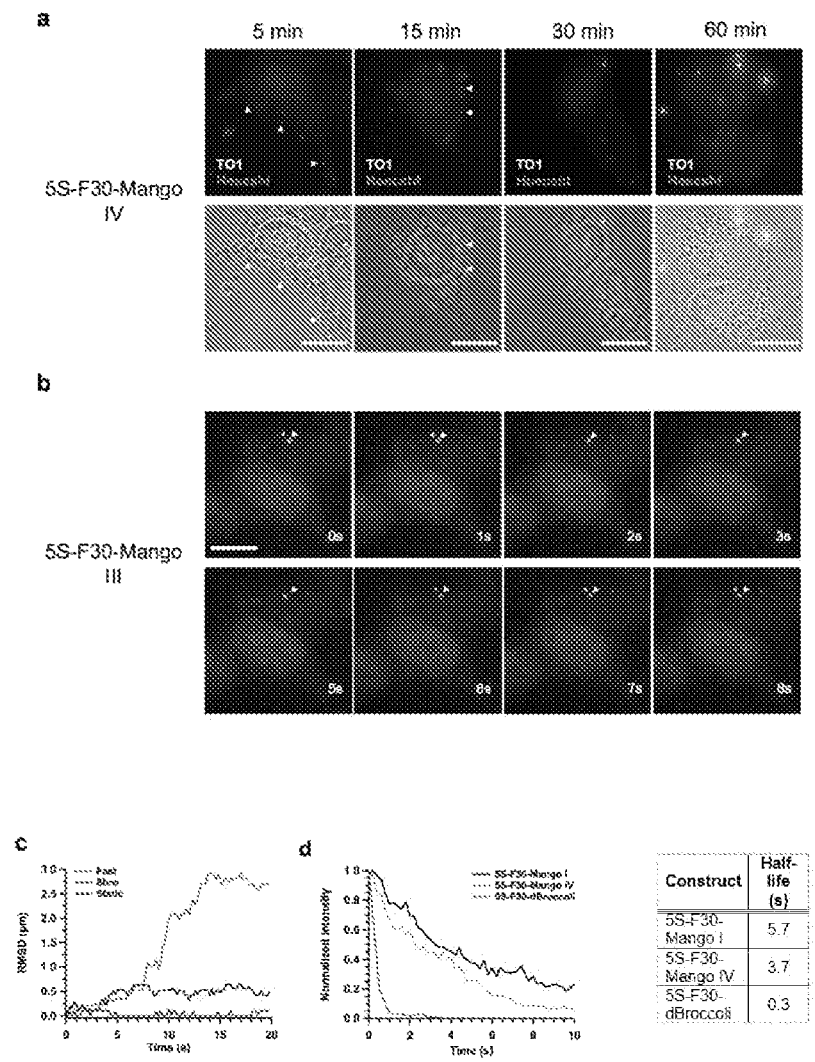

FIG. 16|Formation of 5S-Mango foci and their dynamics in live cells. (a) 5S-Mango IV imaged post cell fixation at 5, 15, 30 and 60 mins after transfection using Lipofectamine based CRISPRMAX transfection reagent. (b) Live-cell imaging of 5S-Mango IV 60 mins post transfection and the RNA was pre-incubated with TO1-Biotin prior to transfection. (c) Root mean-squared displacement (RMSD) of three observed foci with different diffusive behaviors, fast (Green), slow (Blue) and static (Red) shown in Video 3. Scale bars are 10 μm and arrows indicate foci of interest. (d) Normalized photobleaching traces of 5S-F30-Mango I and IV compared to 5S-F30-dBroccoli under constant illumination with an exposure time of 200 ms. Photobleaching half-lives are stated in the table adjacent and were calculated from an exponential fit of each curve.

Figure 17:
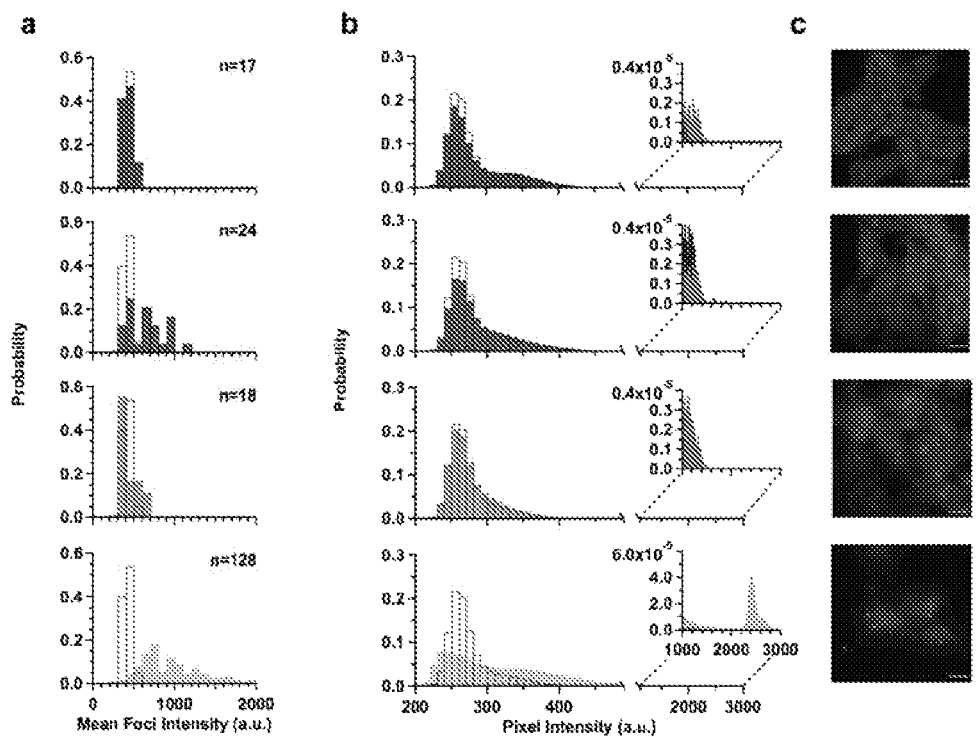

FIG. 17|Intensity Distributions of 5S-Mango I-IV. (a) Mean intensity distributions for 5S-F30-Mango I (Black), II (Blue), III (Green) and IV (Orange) foci compared with the 5S-F30-Control foci distribution (Red). Foci were determined using a diameter threshold 3×3 pixels in the ICY spot detector plugin. Number of foci for the mango tagged datasets shown as n. (b) Total pixel intensity distributions for 5S-Mango I-IV foci compared with the total 5S-F30-Control pixel intensities. Inset depicts the low frequency of high intensity pixels observed for each construct. (c) Representative maximum projections of fixed cells transfected with 5S-F30-Mango I-IV (top to bottom). Scale bars are 10 µm, stained with 1 µg/ml Hoechst 33258 (Blue) and 200 nM TO1-Biotin (Yellow).

Figure 18:
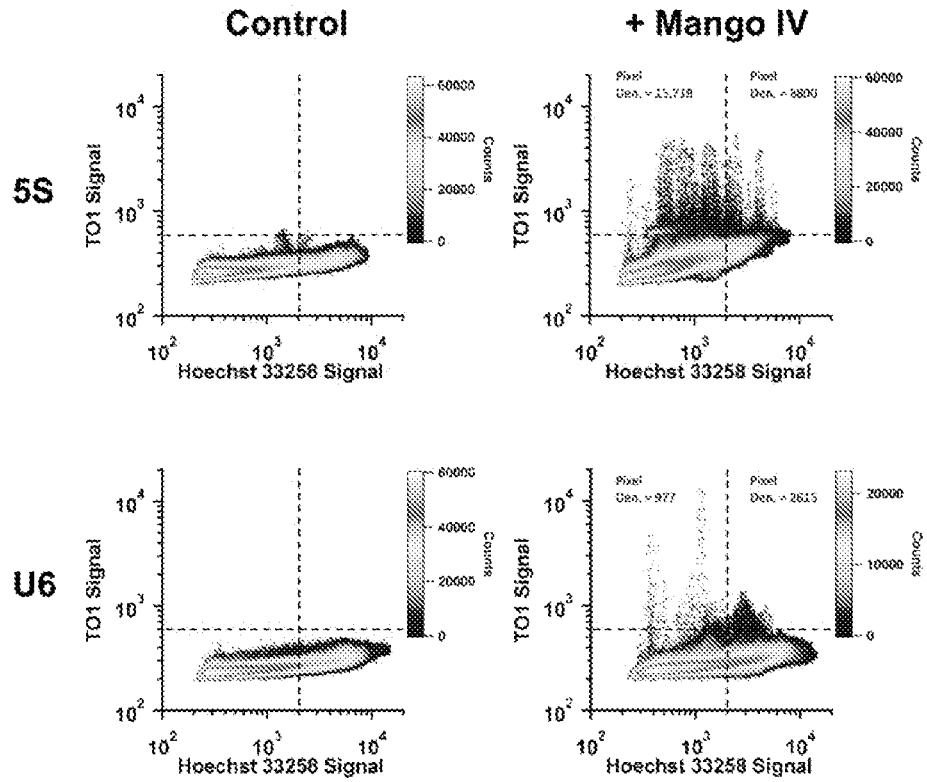

FIG. 18|2D nuclear co-localization plots. Pixel by pixel intensity plots of the TO1-Biotin signal (200 nM) vs Hoechst 33258 signal (1 µg/ml) for both 5S-Mango IV and U6-Mango IV compare to their respective controls in fixed cells. For the Mango specific signal a threshold was set above the 5S-F30-Control background of 600 a.u. Whereas the threshold of the nuclear boundary is observed to be ~2000 a.u. based on Hoechst 33258 staining. The upper quadrants highlight the number of pixels contain within and therefore depict pixels observed outside (upper left) or inside the nucleus (upper right). Each plot contained five maximum projection images with dimensions 1280×1280. The number of cells for 5S-F30-Control, 5S-F30-Mango IV,U6-Control and U6-Mango IV were 57, 114, 131 and 183 respectively.

Figure 19:
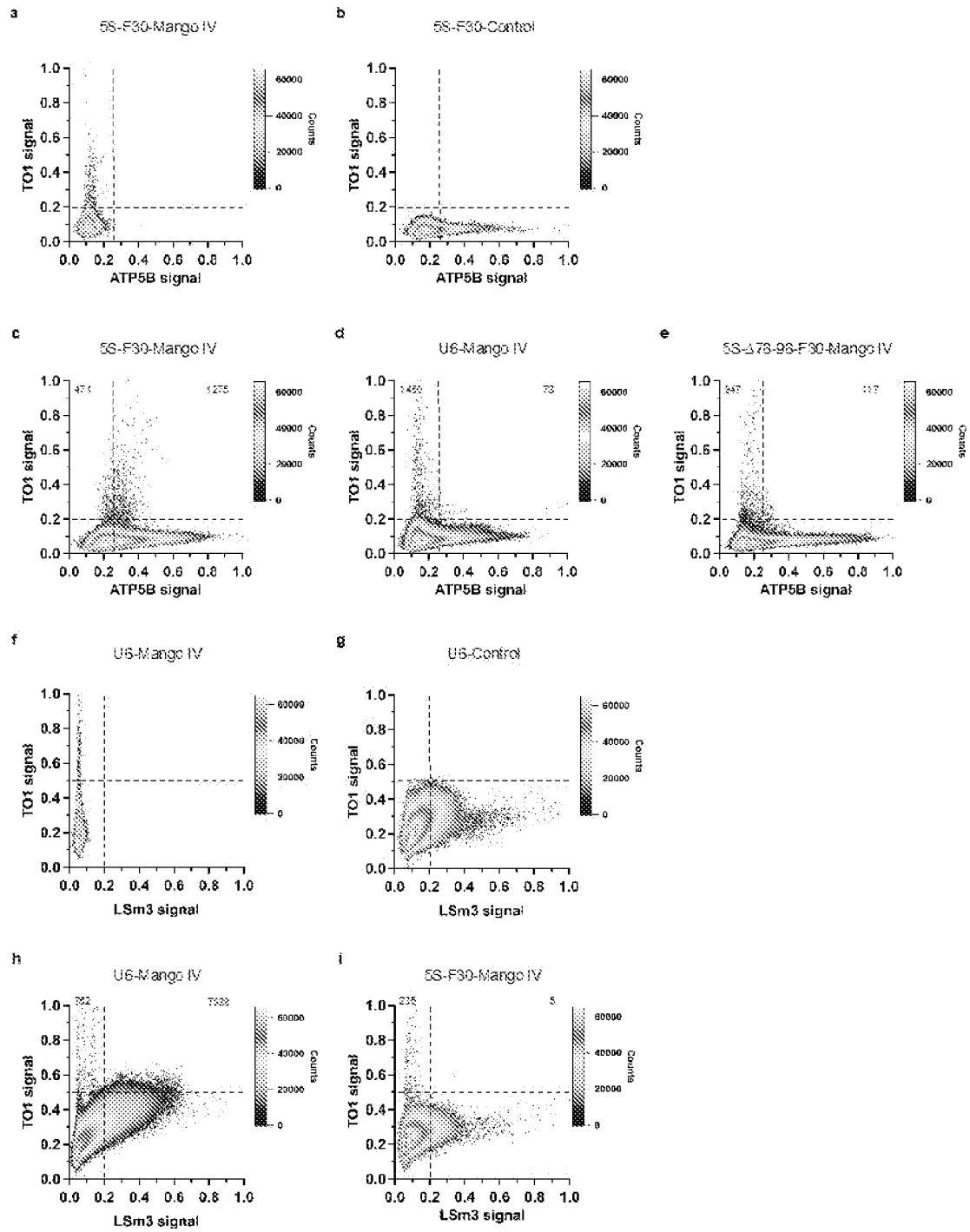

FIG. 19|2D immunostaining co-localization plots. Normalized pixel by pixel intensity plots of the TO1-Biotin signal vs immunostaining signal for both Mitochondria (ATP5B, a-e) and snRNPs (LSm3, f-i). Background intensity values were determined either with a Mango IV tagged construct in the absence of immunostaining or a control construct in the presence of both TO1-Biotin and the appropriate immunostain (a, b, f and g). All plots were normalized by subtracting the background signal in each channel and then normalizing to the highest significant pixel intensity from each of the channels. (c-e) Show the co-localisation patterns of Mango tagged 5S, U6 and 5S Δ78-98 with Mitochondria. (h and i) Show co-localisation patterns of Mango tagged U6 and 5S with snRNPs. The upper quadrants highlight the number of pixels contained within and therefore depict the co-localised (upper right) and distinct (upper left) Mango signal. Each plot contains multiple slices taken from ~five images with dimensions 1280×1280 to accurately determine co-localizing pixels. The number of cells for plots a, b, c, d and e were 66, 26, 178, 217 and 156 respectively. The number of cells for plots f, g, h and i were 34, 108, 165, and 89 respectively.

FIG. 20|Bipartite aptamer systems. This schematic illustration shows the Mango core as a loop, flanked by regions that are complementary to a target RNA of interest.

FIG. 21|Initial screening to find optimal "switch" and the "trigger" constructs for RNA Mango I based bipartite detection system. Looped line is the core Mango I G-quadruplex "GGG AC GGUG C GGAG A GGAG (SEQ ID NO: 1)"; sequences of Mango bait and RNA targets are set out.

FIG. 22|Bipartite mango probes for β-actin mRNA. (A) Model for β-actin mRNA transport, mRNA synthesized in the nucleus binds to Zipcode binding protein (ZBP1) which then associates with other proteins to bind to actin. The RNP then translocates to the leading edge of lamellipodia. (B). Fluorescence response of Mango I constructs that target β-actin mRNA. The Bipartite switch (50 nM) was added (at 10 min) to (100 nM) TO1-B. After 60 mins, the complementary in vitro transcribed 'trigger' RNA (100 nM) was added. (C) shows the sequence of the probe and the target sequences used.

FIG. 23|Bipartite construct with Mango II and 4 bp inhibitory stem. (A and B) Schematic representation of Mango II construct without inhibitory stem (MII) and with inhibitory stem (MII +4i). (C) Fluorescence response of the biparite constructs. The Bipartite switch (50 nM) was added (at 10 min) to (100 nM) TO1-B. At 70 mins, the complementary in vitro transcribed 'trigger' RNA (100 nM) was added. Right—Table showing the contrast of bipartite constructs with and without inhibitory stem.

FIG. 24|Effect of inhibitory stem length on contrast and rate of fluorescence emergence. (A) The number associated with the MII annotation refers to the number of interfering nucleotides. The Bipartite switch (50 nM) was added (at 20 min) to (100 nM) TO1-B. After 80 mins, the complementary in vitro transcribed 'trigger' RNA (100 nM) was added. (B) Sequences of the constructs used in the panel (A). In bold are potentially base pairing nucleotides that destabilize the G-quadruplex in the absence of trigger (target RNA).

FIG. 25|Schematic illustration of a generalized RNA Mango-based bipartite construct targeted to an RNA of interest.

FIG. 26|Mango IV based bipartite constructs alignment.

FIG. 27|Mango IV based bipartite construct measured contrast levels.

FIG. 28|Sequences of Mango switch probe used. Probe sequence shown 5' to 3' followed immediately by the complementary target shown 3' to 5'. Mango I core sequence shown in purple, Mango II core sequence shown in blue.

Figure 29:
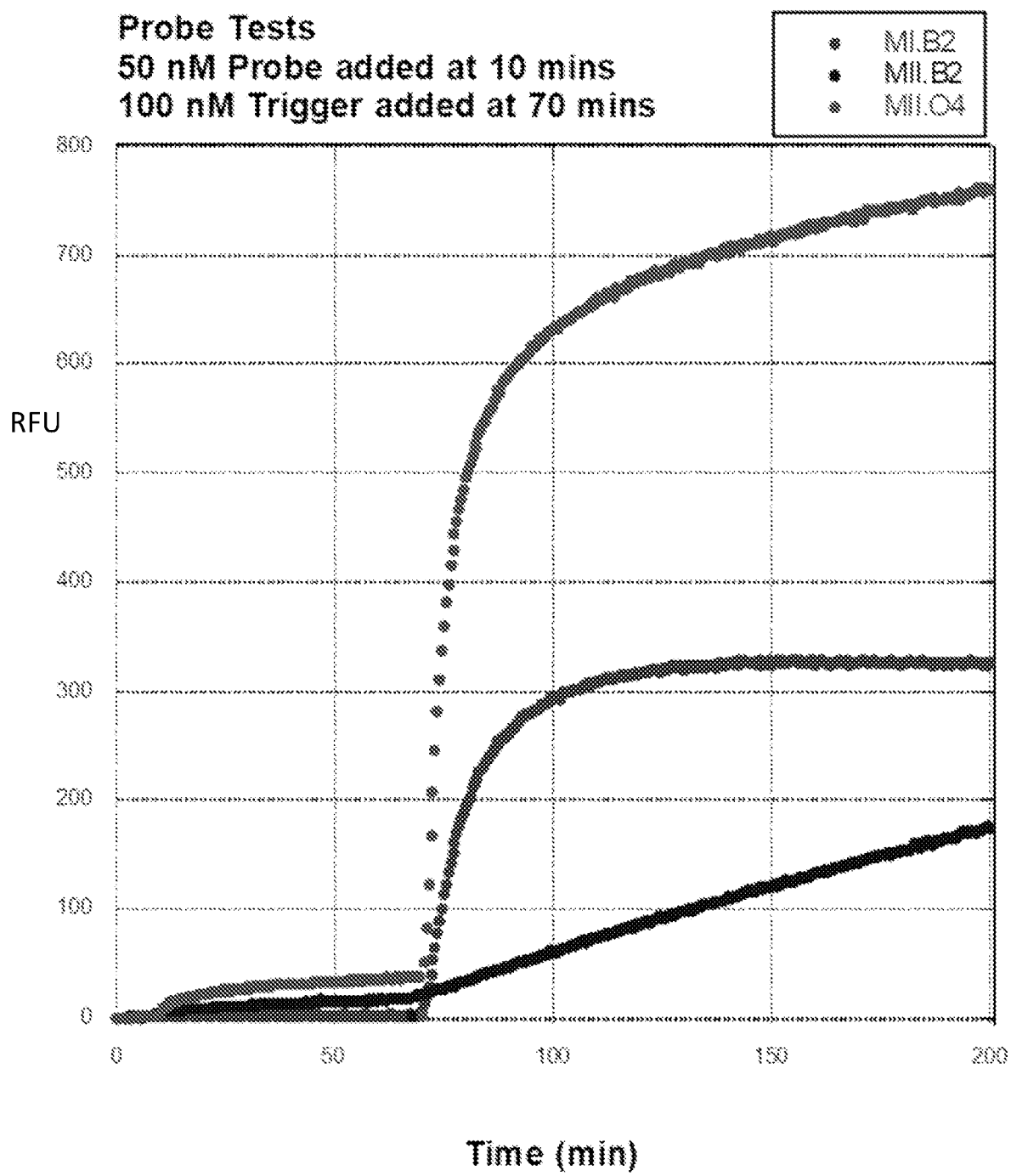

FIG. 29|Time course of in vivo Mango I & II switch probes. 140 mM potassium chloride, 1 mM magnesium chloride, 10 mM sodium phosphate buffer (pH 7.2), and 100 nM TO1-biotin was incubated at 25° C. for 5 min before the addition of probe to a final of 50 nM. After 60 min incubation, a short complementary trigger strand was added to a final of 100 nM. Fluorescence excitation at 510 nm and emission read at 535 nm.

Figure 30:
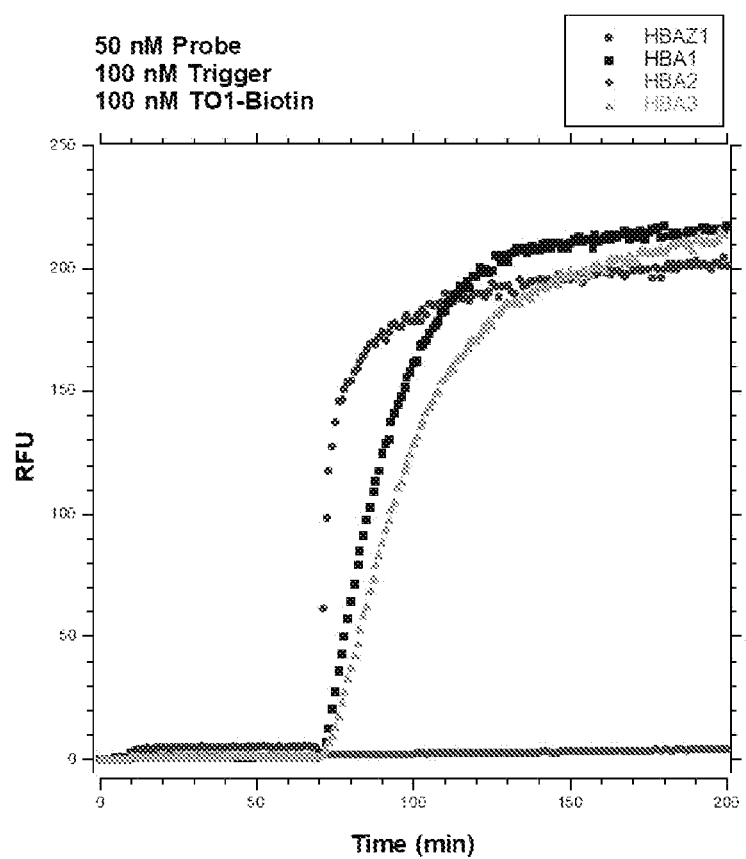

FIG. 30|Time course of in vivo Mango switch probes. 140 mM potassium chloride, 1 mM magnesium chloride, 10 mM sodium phosphate buffer (pH 7.2), and 100 nM TO1-biotin was incubated at 25° C. for 5 min before the addition of probe to a final of 50 nM. After 60 min incubation, a short complementary trigger strand was added to a final of 100 nM. Fluorescence excitation at 510 nm and emission read at 535 nm. Before trigger corresponds to t=69 min, after trigger t=200 min, C=after trigger/before trigger.

Figure 31:
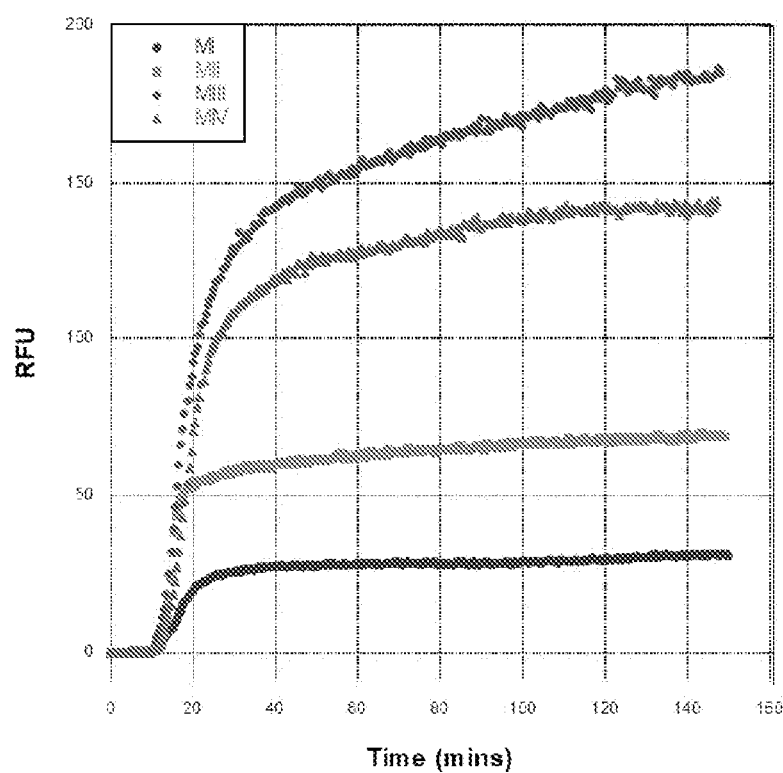

FIG. 31|T7 transcription of all unimolecular templates. Assay performed in 40 mM Tris pH 7.9, 2.5 mM spermidine, 26 mM MgCl$_2$, 0.01% triton X-100, 140 mM KCl, 0.5 µM DNA template, 200 nM TO1-Biotin, 10 mM DTT, 0.5 µM T7 promoter compliment strand, 0.3 U/600 µL pyrophosphatase (Invitrogen), 8 mM GTP, 5 mM CTP, 2 mM UTP, 5 mM ATP. At t=10, 30 µL/600 µL reaction diluted T7 enzyme was added.

Figure 32:
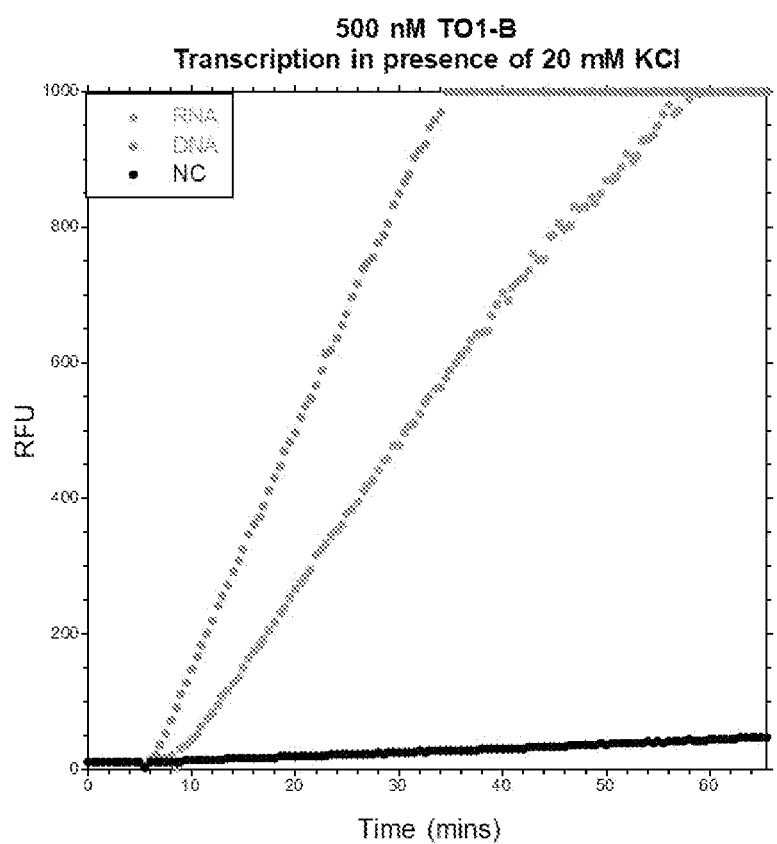

FIG. 32|Rolling circle transcription of Mango III. T7 RNA polymerase added to supplemented mixture at 5 min 30 sec. Fluorescence excitation at 510 nm and emission at 535 nm. Orange: RNA target with oligo ligated with SplintR Ligase (NEB), Blue: DNA target with oligo ligated with T4 DNA Ligase (NEB).

Figure 33:
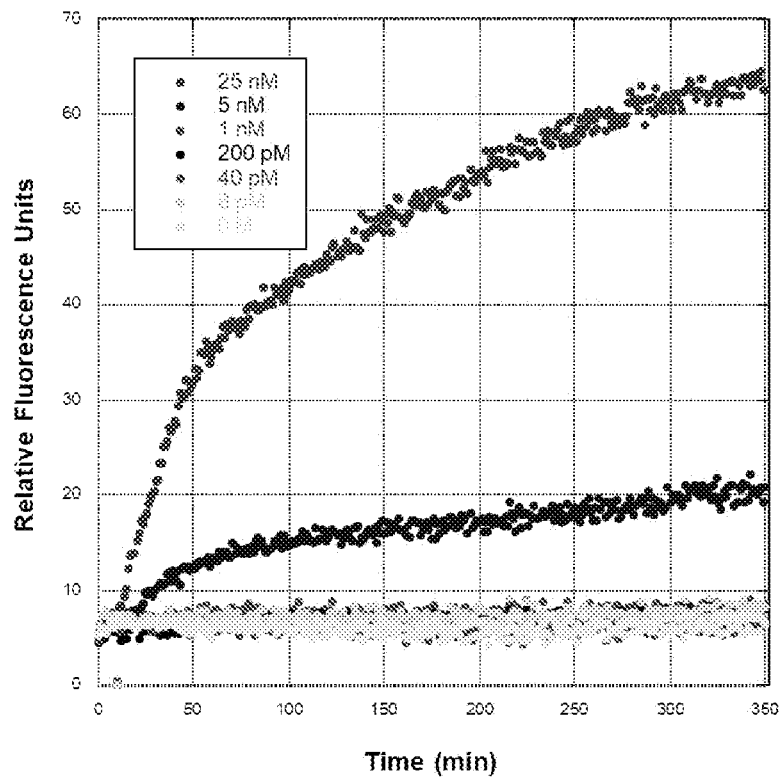

FIG. 33|Rolling circle transcription of Mango III. Circular template (represented in FIG. 34), was titrated and room temperature T7 transcription was initiated in the presence of excess of TO1-Biotin fluorophore.

Figure 34:
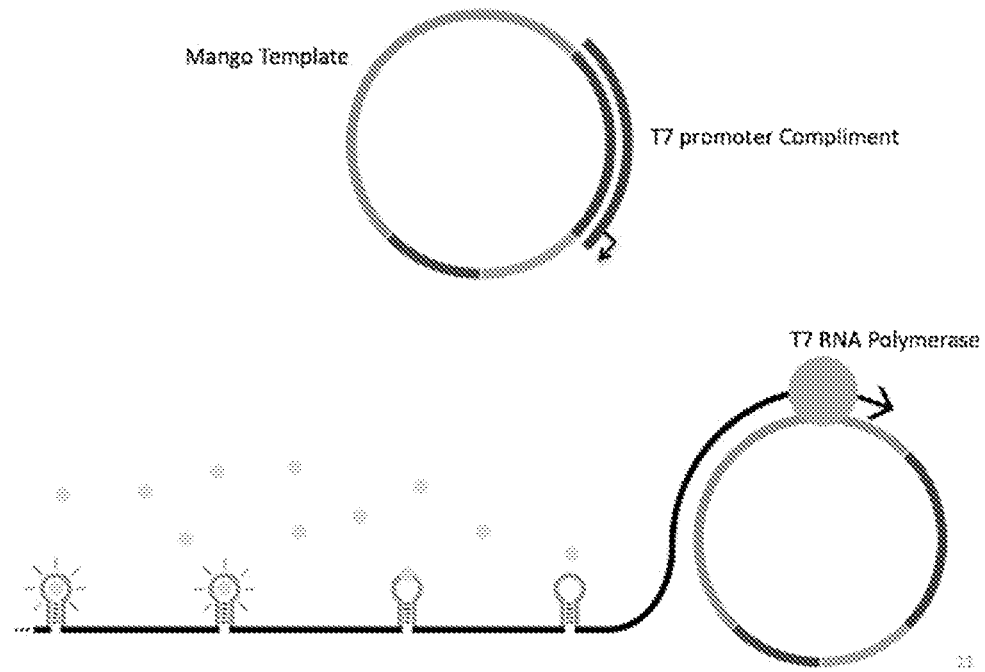

FIG. 34|Rolling circle transcription of Mango III. Circular construct represented here was used in FIG. 33. Purple: T7 binding site, red and orange template hybridization arms (ligation site between them). Blue Mango sequence. T7 transcription of this DNA template results in multiple Mango repeats that once formed are able to bind TO1-Biotin (yellow hexagons) and fluoresce.

Figure 35:
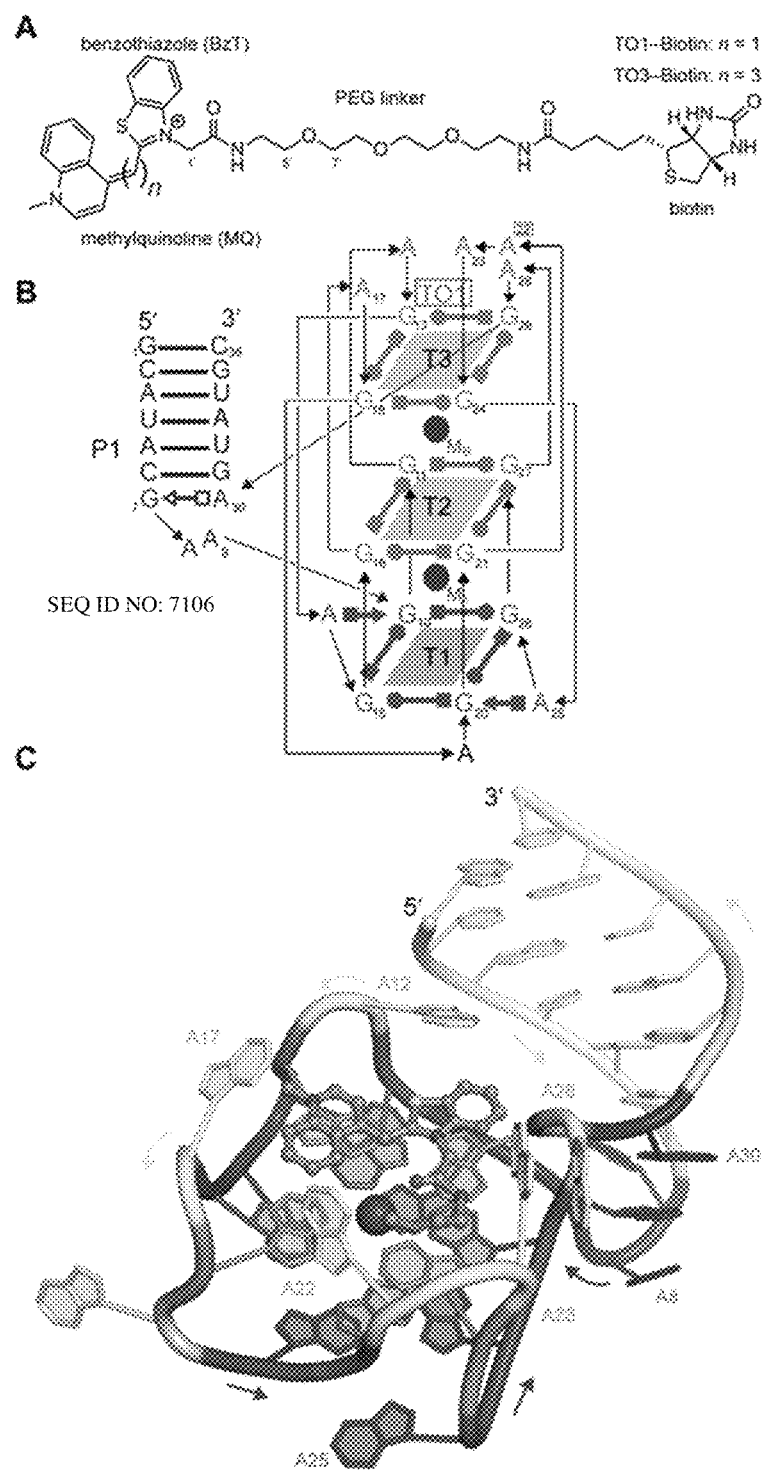

FIG. 35|Structure of Mango-II in complex with TO1-Biotin. (A) Chemical structures of TO1-Biotin and TO3-Biotin. The latter contains two additional methine carbons. (B) Secondary structure of the Mango-II-TO1-Biotin complex. Thin lines with arrows denote connectivity. Base pairs are represented with Leontis-Westhof symbols.[11] Location of fluorophore and two potassium ions (TO1, $M_A$, and $M_B$) is indicated. This color scheme is used throughout the manuscript except where noted. (C) Cartoon representation of the Mango-II-TO1-Biotin complex. Arrows adjacent to the cartoon denote chain direction.

Figure 36:
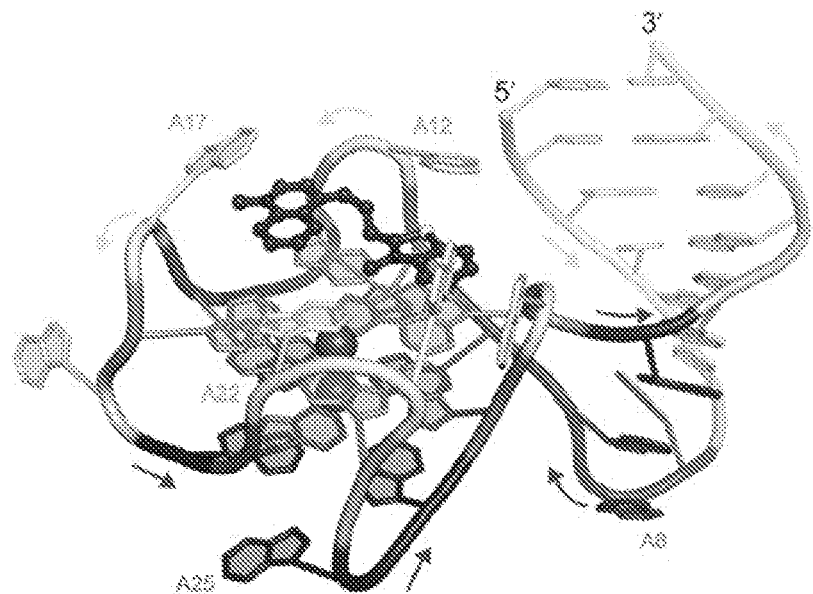

FIG. 36|Structure of the Mango-II-TO3-Biotin complex. Cartoon representation of chain A of the Mango-II-TO3-Biotin complex. Color scheme is the same as FIG. 1C with the exception of TO3-Biotin colored as red sticks FIG. 37|Analytical ultracentrifugation of Mango-II-TO1-Biotin complex.

Figure 38:
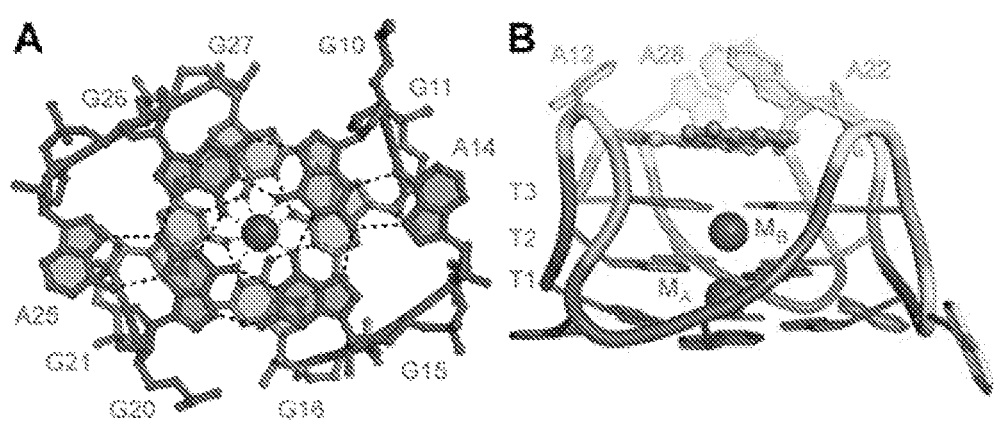

FIG. 38|The Mango-II G-quadruplex. (A) Augmented Tier 1 (T1, purple) and Tier 2 G-quartets (T2, blue) of the Mango-II-TO1-Biotin complex. T1 is augmented into a hexad. (B) Side view.

Figure 39:
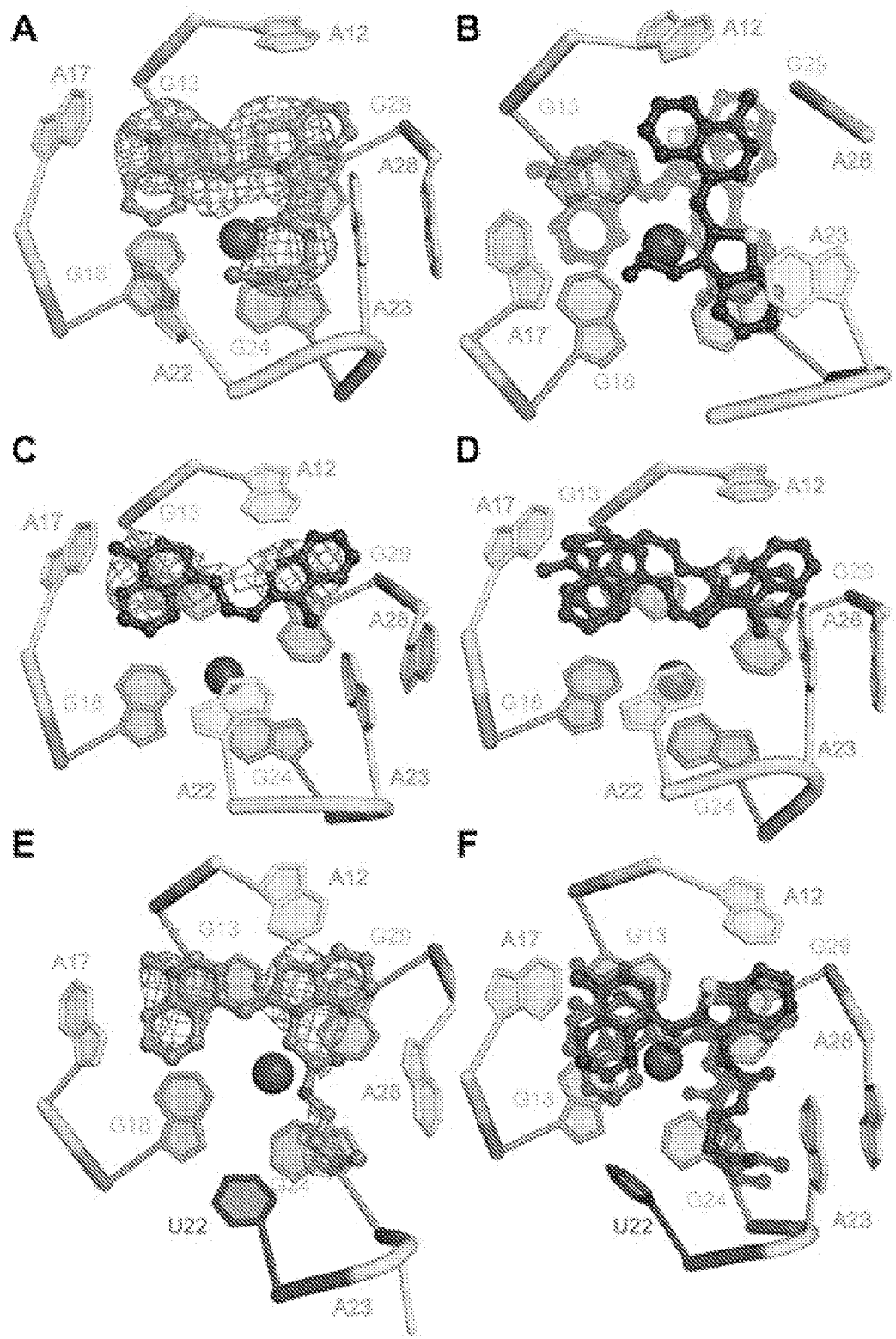

FIG. 39|Plasticity of the Mango-II ligand binding pocket. (A) Cartoon representation of the ligand binding pocket of chain A of the Mango-II-TO1-Biotin complex structure, with fluorophore electron density (2|Fo|−|Fc| prior to building the ligand, contoured at 1.2 σ, blue mesh) shown in mesh. (B) Overlay of the fluorophores from the three complexes in the asymmetric unit aligned on chain C. TO1-Biotin from chains A, B, and C are shown in transparent red, transparent purple and blue, respectively. In chain C, A22 and A28 are disordered. (C) Fluorophore electron density (2|Fo|−|Fc|) prior to building the ligand, contoured at 1.2 σ, blue mesh) for chain A of the Mango-II-TO3-Biotin complex structure. (D) Overlay of the ligands in chain A (purple) and chain B (red). The chain A RNA is shown. (E) Cartoon representation of the ligand binding pocket of chain B of the Mango-II (A22U)-TO1-Biotin complex Fluorophore electron density (2|Fo|−|Fc| prior to building the ligand, contoured at 1.2 σ) blue mesh. (F) Overlay of the ligands in chains A, B and C (purple, blue and red, respectively). Chain A RNA shown.

Figure 40:
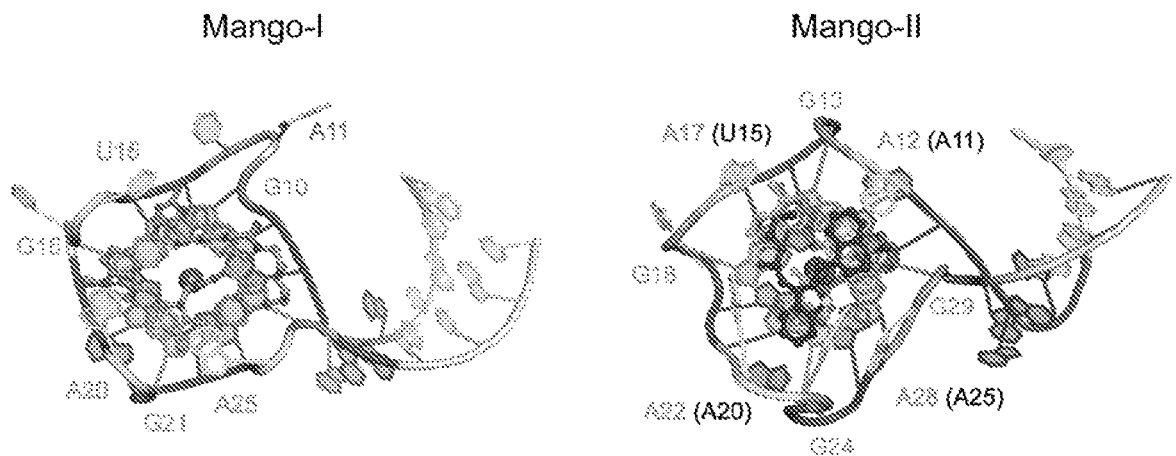

FIG. 40|Structural comparison of the Mango-I-TO1-Biotin complex and the Mango-II-TO1-Biotin complex. Side by side comparison of Mango-I-TO1-Biotin (left) and Mango-II-TO1-Biotin (right) showing distinct, unequivalent conformations of the TO1-Biotin ligand in each structure.

Figure 41:
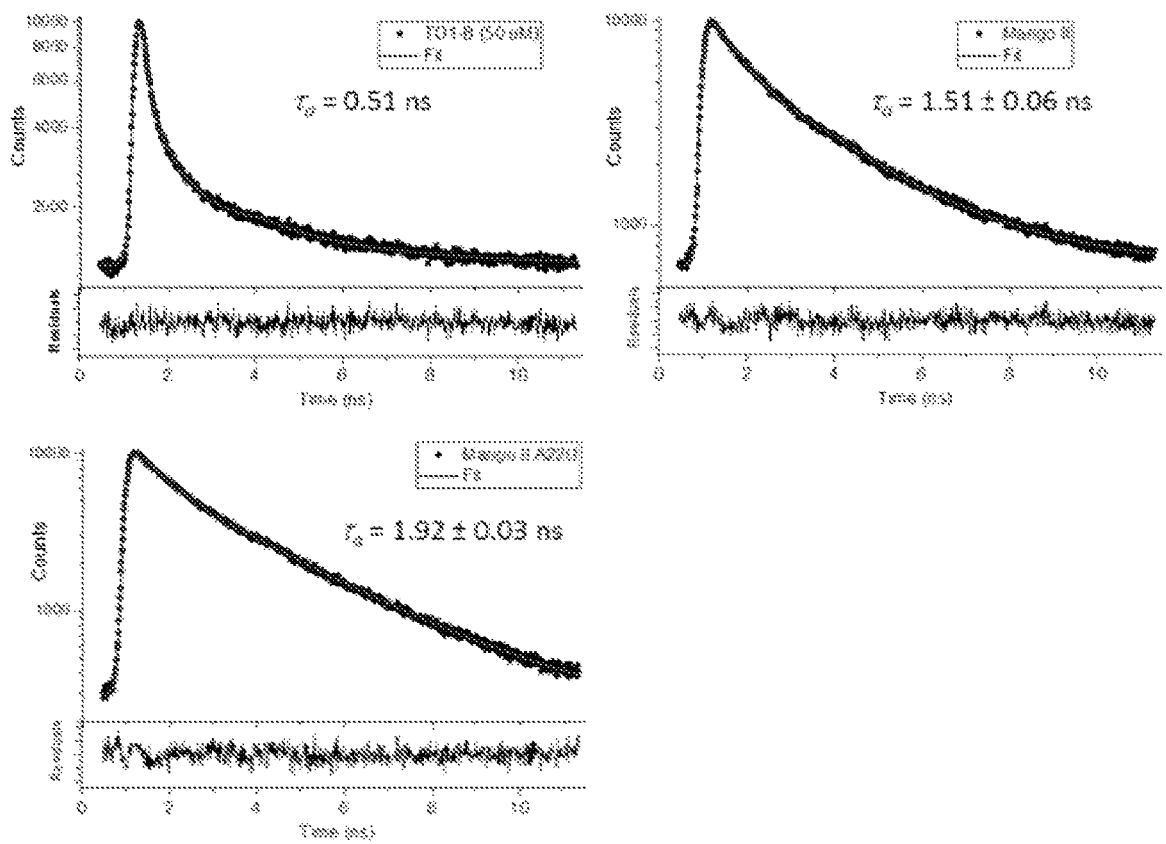

FIG. 41|Fluorescence lifetime traces of TO1-Biotin, Mango-II wt and A22U with TO1-Biotin. Comparison of the lifetime decay obtained from TO1-B free in solution (left panel), and when bound to Mango II wt (central panel), or Mango II A22U (right panel). In each panel the data are presented as filled circles, the red line shows the fit to the data, reconvoluted with the IRF, and underneath the data the residuals from the fit are shown. On each panel, the intensity-weighted average lifetime is reported. For details about the individual lifetime components and their amplitudes.

Figure 42:
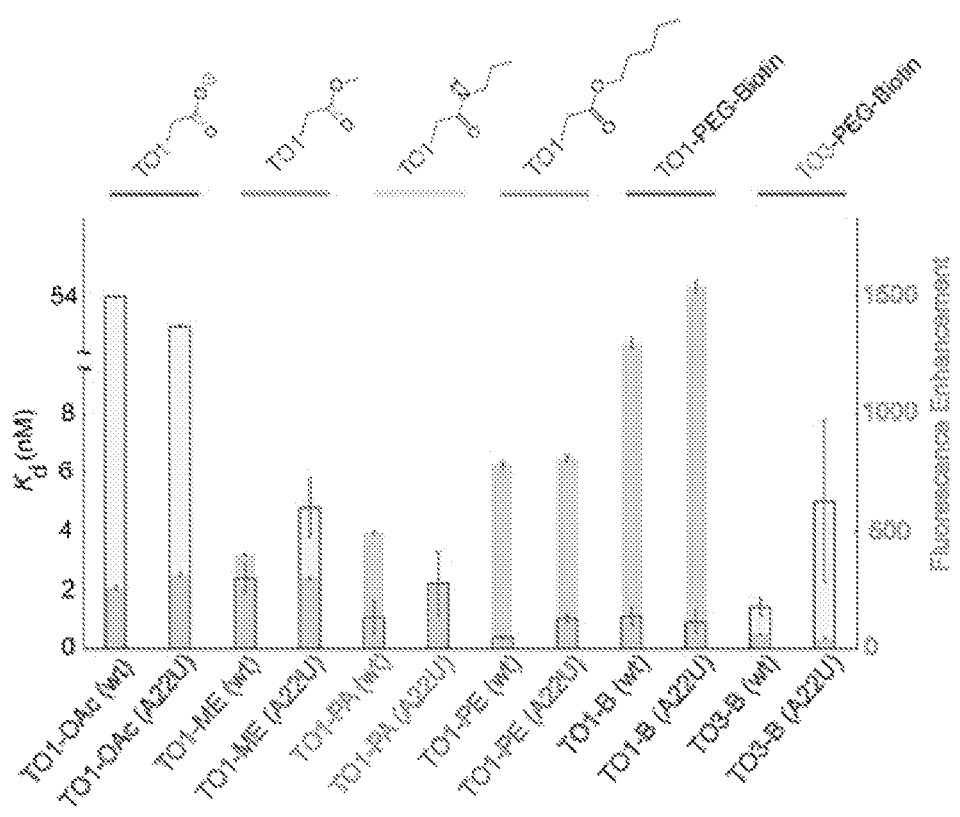

FIG. 42|Mango-II binding and fluorescence enhancement of thiazole orange derivatives. Dissociation constants, Kd, and fluorescence enhancement, (gray and green bars, respectively) for various TO1-Biotin derivatives. Length of the linker between TO1 and biotin increases from left to right.

Figure 43:
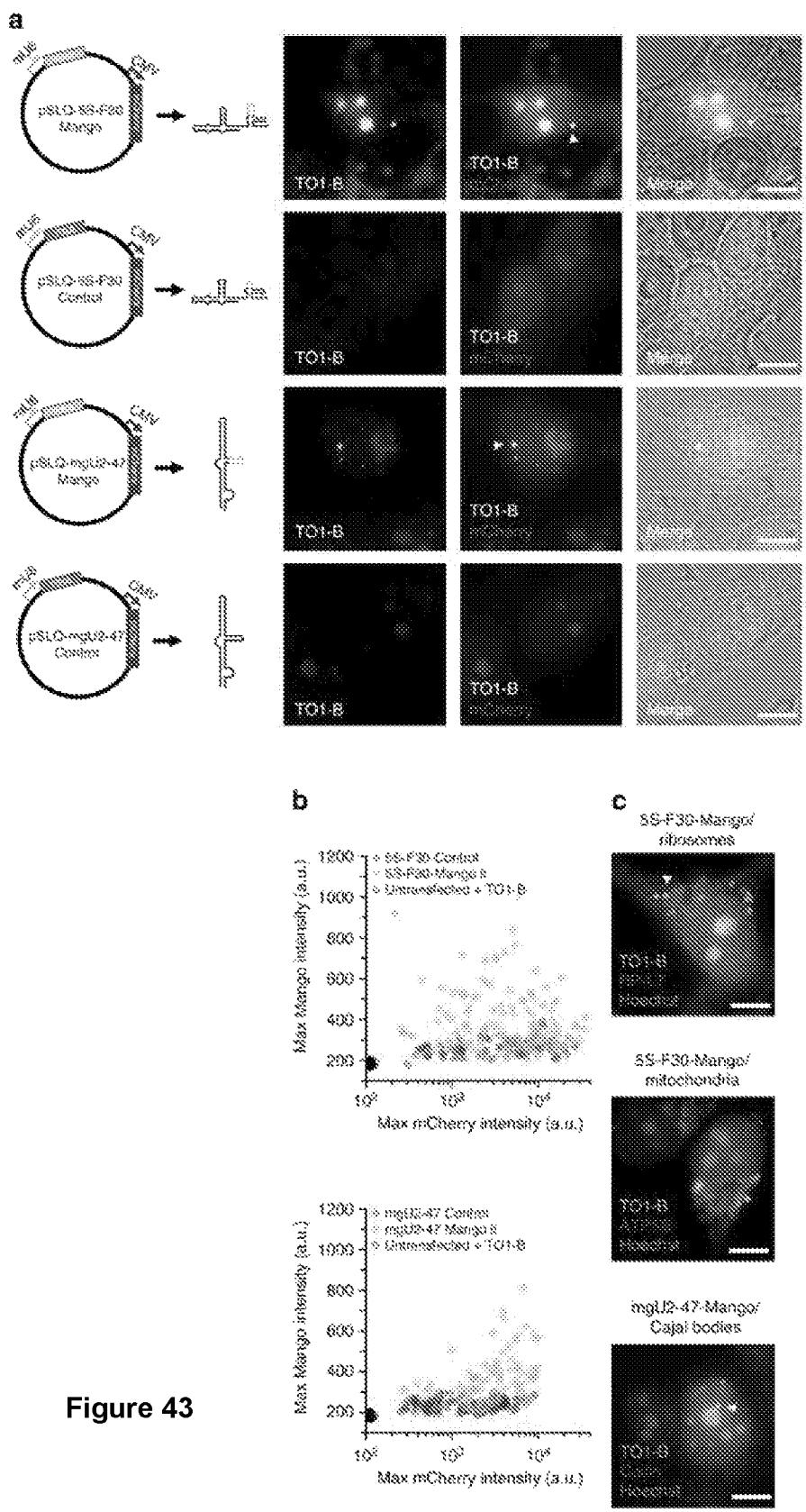

FIG. 43|Fluorogenic RNA Mango aptamers for imaging small non-coding RNAs in mammalian cells. Cellular imaging of genetically encoded Mango II-tagged RNAs. a) Diagram of plasmid constructs with the 5S rRNAs and mgU2-47 scaRNAs under the control of a murine U6 promoter (Pol III) and co-expression of a mCherry reporter gene (CMV promoter). Shown adjacent are images of individual slices of fixed cells either expressing Mango II-tagged RNAs (top) or control RNAs (bottom) with the TO1-B (200 nM) signal in yellow, mCherry in red and brightfield image in greyscale. Arrows depict significant cellular and nuclear foci. Scale bar=10 μm. b) 2D maximum intensity plots of individual nucleoli and Mango II specific foci for both the TO1-B signal (y axis) and mCherry signal (x axis—log 10 scale). The number of cells for 5S-F30-Control, 5S-F30-Mango II, untransfected cells+TO1-B, mgU2-47 Control and mgU2-47 Mango II were 89, 167, 98, 130 and 117 respectively. c) Maximum projections of cytoplasmic 5S-F30-Mango IV foci and nuclear mgU2-47 foci from plasmid expression in conjunction with immunostained ribosomes (RP-L7), mitochondria (ATP5B) and Cajal bodies (Coilin). Arrows depict significantly co-localized foci, scale bar=10 μm FIG. 44|Crystal contacts of the Mango-III-TO1-Biotin Complex FIG. 45|Analytical Ultracentrifugation of the Mango-III-TO1-Biotin FIG. 46|Structure of the Mango-III-TO1-Biotin complex. a, Chemical structure of TO1-Biotin and TO3-Biotin. b, Secondary structure. Thin lines with arrowheads denote connectivity. Leontis-Westhof symbols denote base pairs. c, Cartoon representation of the three-dimensional structure of the complex colored as in (b). Arrows indicate 5' to 3' chain direction, and purple spheres represent $K^+$. d, Sequence alignment of Mango-I and Mango-III aptamer RNA cores colored as in (b). Lines depict base pairing, except for the G-Quadruplex (black lines). Co-varying nucleotide shaded gray.

Figure 47:
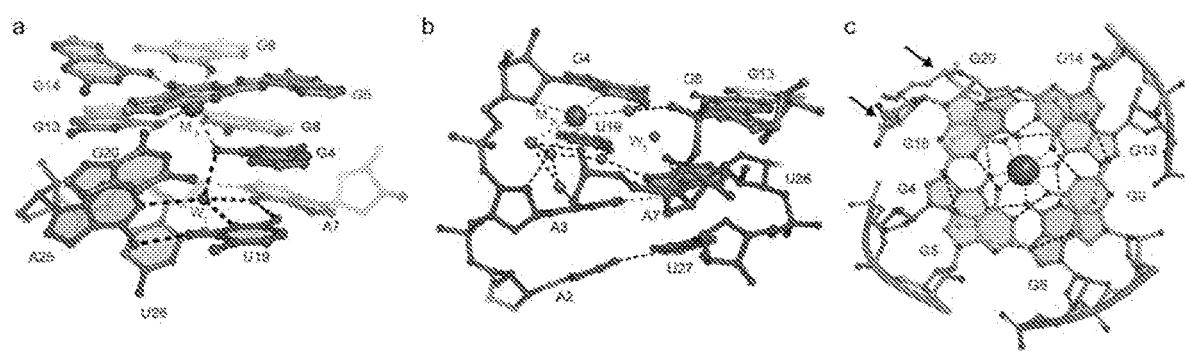

FIG. 47|Structure of the duplex-triplex-quadruplex junction. a, Base positions of T1, T2 and T3 as well as co-solvent interactions in the Mango-III core. U31, A30 and G25 are buckled and stacking on each other. A central water molecule ($W_1$) is represented with a red sphere and the central $K^+$ ion ($M_A$) is represented by a purple sphere. (b) Hydrated metal ion network (purple and red spheres) with hydrogen bonding interactions between P1 (red), T1 (purple) and T2

(marine) represented by black dashed lines. Inner-sphere metal ion coordination is represented by orange dashed lines. (c) Ball-and-stick representation of the T2 and T3 tiers and the central potassium ion $M_4$. Black and orange dashed lines represent hydrogen-bonding and inner-sphere cation coordination, respectively.

Figure 48:
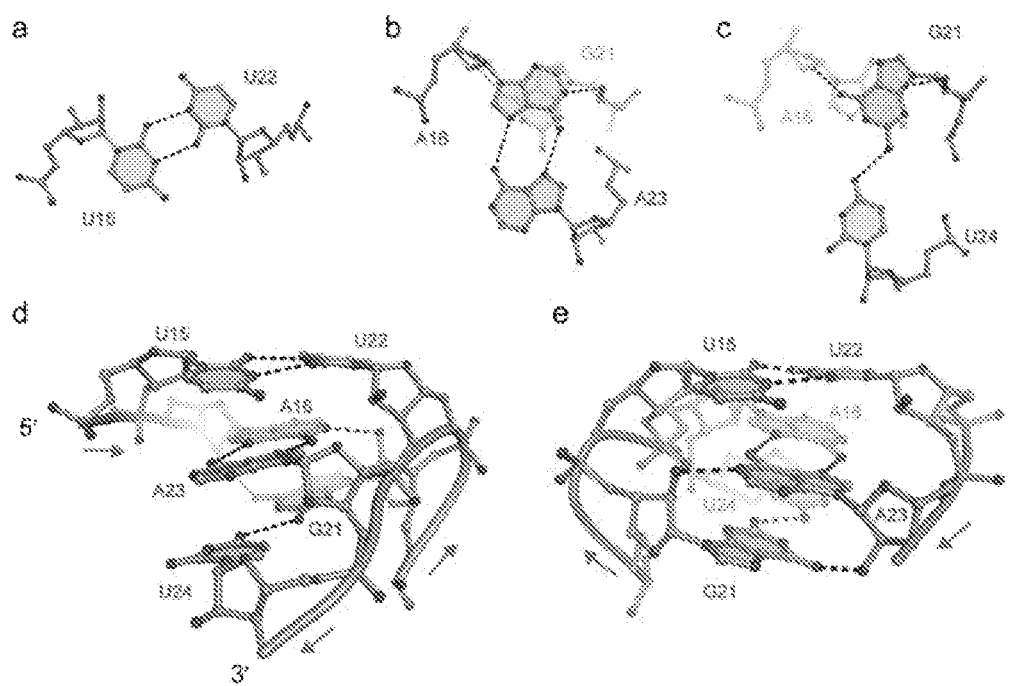

FIG. 48|Structure of the non-canonical P2 helix a, U15-U22 trans Watson-Crick base pair. b, A16•A23 trans Hoogsteen base pair. Dashed lines, hydrogen bonds. c, G21•U24 cis single-hydrogen bond base pair. G21 is shown to highlight cross-strand stacking. A16 is shown to highlight cross-strand stacking. d, View of P2 from the direction of the G21-U24 strand. Arrows denote 5'- to 3' chain direction. e, 180° rotation along a vertical axis.

Figure 49:
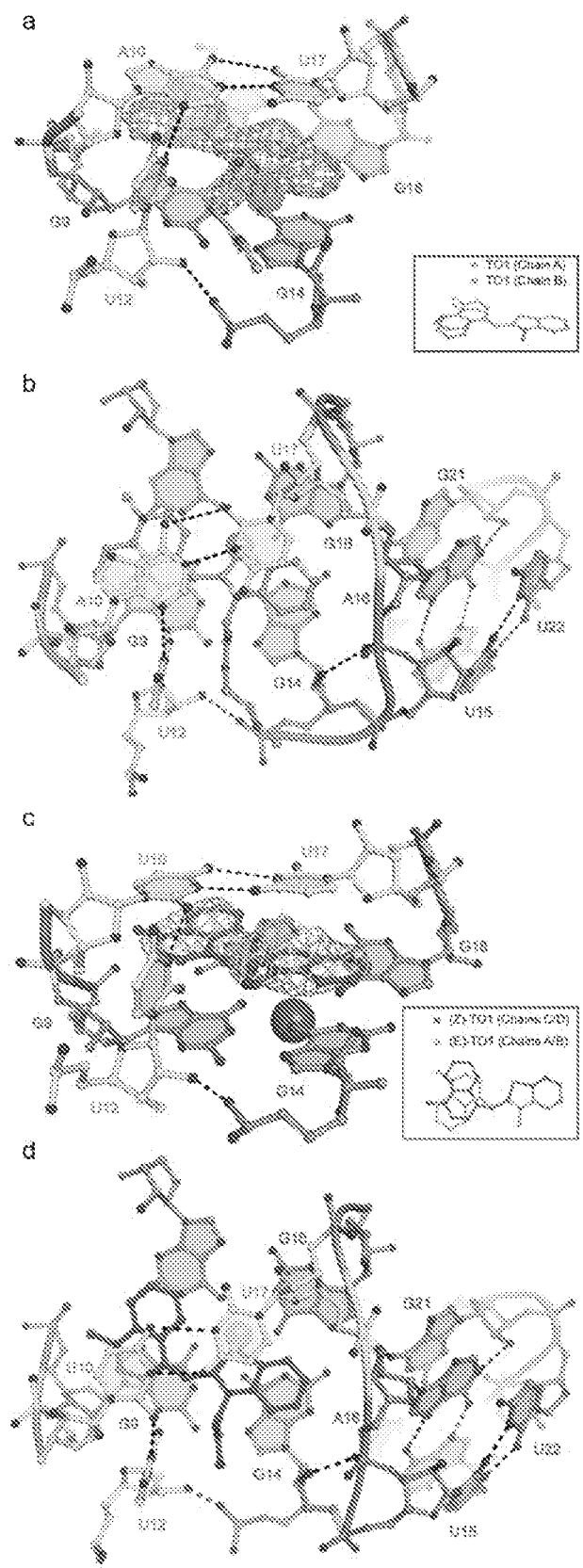

FIG. 49|Fluorophore binding by Mango-III. (a) Ball-and-stick representation of the ligand binding pocket superimposed on the $2|F_o|-|F_c|$ electron density map calculated before addition of ligand to the crystallographic model (grey mesh, 1.5σ contour). The native anomalous difference Fourier synthesis is shown as a solid green surface at 4σ contour. Inset shows the structural alignment of the TO1-Biotin fluorophores from each chain in the Mango-III(wt)-TO1-Biotin complex. (b) Top view of the Mango-III-TO1-Biotin binding-pocket and P2 (orange ball-and-stick). (c) Ball-and-stick representation of the ligand binding pocket of Mango-III(A15U)-TO1-Biotin complex superimposed on the $2|F_o|-|F_c|$ electron density map calculated before addition of ligand to the crystallographic model (grey mesh, 1.2σ contour). Inset shows the structural alignment of two TO1-Biotin fluorophores from each chains A and C of the Mango-III(A15U)-TO1-Biotin structure. (d) Top view of the Mango-III(A15U)-TO1-Biotin binding-pocket and P2 (orange ball-and-stick).

Figures 50, 51:
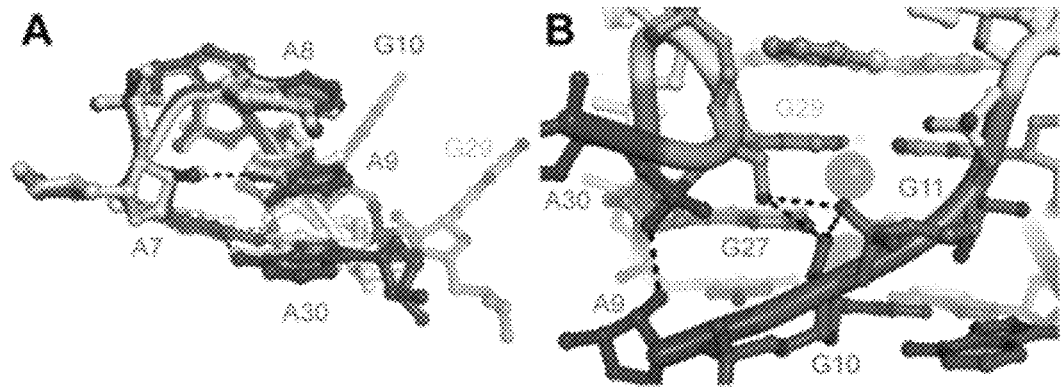

FIG. 50|Structure guided re-selection of 'Super-Mango-III'.

FIG. 51|Structure of the Mango-II helix junction. (A) Tetraloop like junction of Mango-II superimposed with a canonical GAAA tetraloop (PDB 4FNJ)*, RMSD 0.30 Å. (B) Adjacent region to the tetraloop junction showing stabilizing hydrogen bonding interactions.

FIG. 52|$\#_1$ and $\#_2$ Mutations and effect on binding and MIII construct brightness.

FIG. 53|Brightness response of MI, MII, MIII mutants and MIV to a fluorophore series. Single fluorescence point reads done in triplicate. 500 nM RNa was incubated with 10 nM fluorophore at room temperature for ~1 h to allow folding of the RNA aptamers in 1×WB (140 mM KCl, 1 mM $MgCl_2$, 10 mM $NaH_2PO_4$, pH 7.2.

DETAILED DESCRIPTION

Microfluidic Isolation of Mango Aptamers

Figure 1:
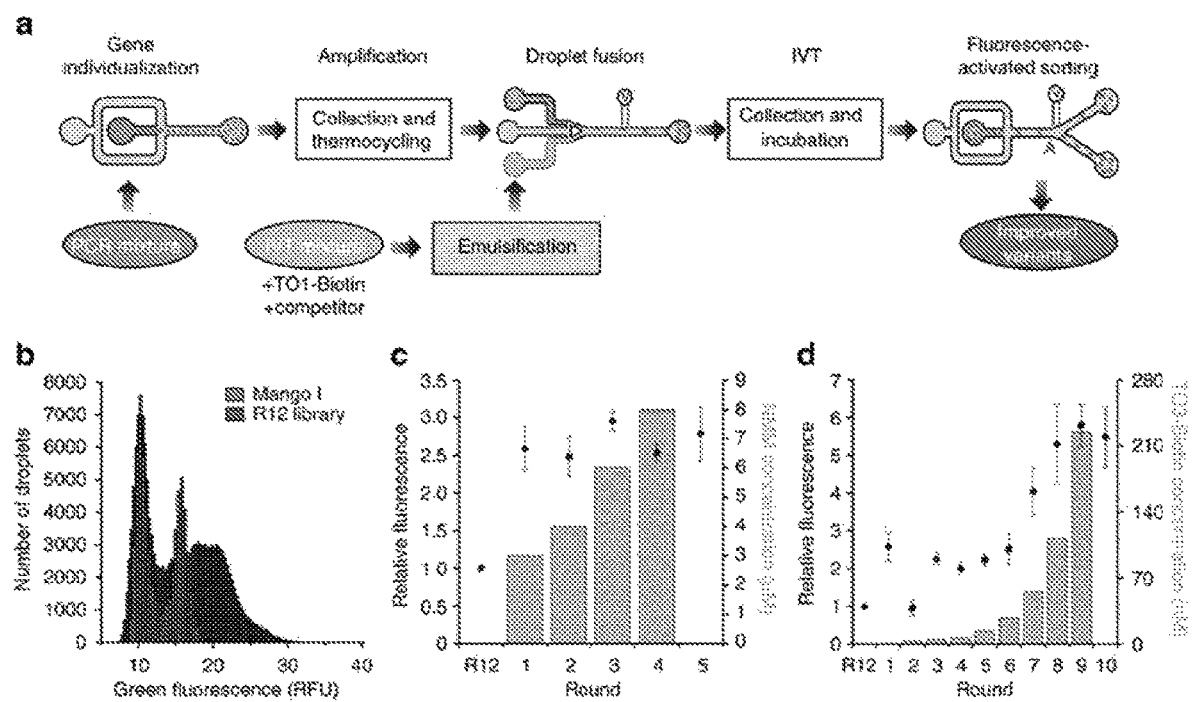
FIG. 1|Selection of TO1-Biotin binding variants using droplet-based microfluidics fluorescence screening in the presence of competitors. (a) Experimental workflow for microfluidic-assisted fluorescence screening. Ovals and boxes represent on- and off-chip steps, respectively. Three microfluidic devices were used for gene individualization in 2.5 pL droplets containing PCR mixture; after thermocycling, fusing each PCR droplet with a droplet containing an in vitro transcription (IVT) mixture supplemented with TO1-Biotin and competitor (NMM or TO3-Biotin); and, after incubation, the fluorescence profile of each droplet was analysed and sorted accordingly. (b) Fluorescence profile of droplets containing Mango I or the initial R12 library (~200,000 variants, Supplementary Table 1). Droplets containing no DNA yield a population of empty (initially) was found to have a fluorescence of 10 RFUs. (c) Improvement in fluorescence enhancement of aptamer libraries during the screening process in the presence of increasing amounts of NMM. The fluorescence (black dots) of the RNA libraries in complex with TO1-Biotin was determined by mixing 2 μM RNA and 100 nM TO1-Biotin in the absence of NMM. These values were normalized to that of the starting library (R12). (d) Enhancement in fluorescence resulting from selection with TO3-Biotin competitor. The fluorescence (black circles) was determined after each round by mixing 300 nM RNA and 100 nM TO1-Biotin in the absence of TO3-Biotin. The values were normalized to that of the starting library (R12). The blue bars represent the concentration of competitor used in each round of selection. For each sort, the gated populations can be found in FIG. 5.

As illustrated in FIG. 1, TO1-Biotin binding variants were selected using droplet-based microfluidics fluorescence screening in the presence of competitors. The fluorescence profile of droplets containing Mango-I of an initial library (~200,000 variants, designated R12) is shown in Table 3.

TABLE 3

Metrics of the fluorescence profiling of Mango and R12

| Round | Temperature (° C.) | TO-1 (nM) | λ value | Fusion efficiency (%) | Number of analyzed droplets | Number of analyzed variants |
|---|---|---|---|---|---|---|
| R12-library | 25 | 100 | 1.25 | 95 | 168,441 | 200,023 |
| Mango | 25 | 100 | 0.54 | 95 | 63,200 | 1 |

The microfluidic-assisted in vitro compartmentalisation (pIVC, FIG. 1a), shows that a significant fraction of molecules in the R12 library are brighter than Mango I (FIG. 1b).

Figure 4:
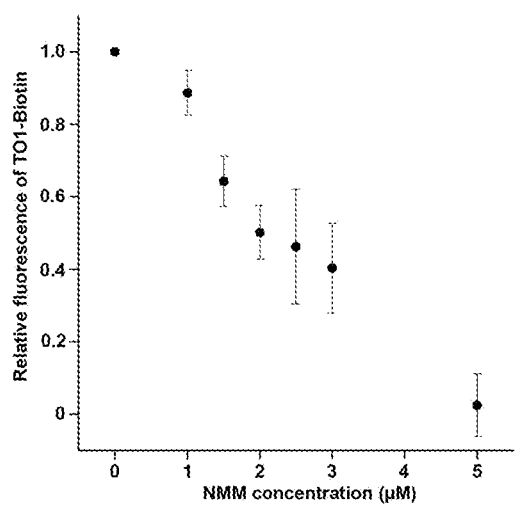
FIG. 4|Effect of N-methyl mesoporphyrin IX (NMM) concentration on TO1-biotin/Mango I fluorescence. RNA aptamer at 1 μM was incubated with 100 nM of TO1-Biotin and a concentration of NMM ranging from 0 to 5 μM·Green fluorescence was recorded (ex: 492 nm/em: 516 nm) in a real-time thermocycler (Mx 3005P, Agilent). Values are normalized to that of the 0 μM NMM point and are the mean of two independent experiments and error bars correspond to ±1 standard error.
Figure 5:
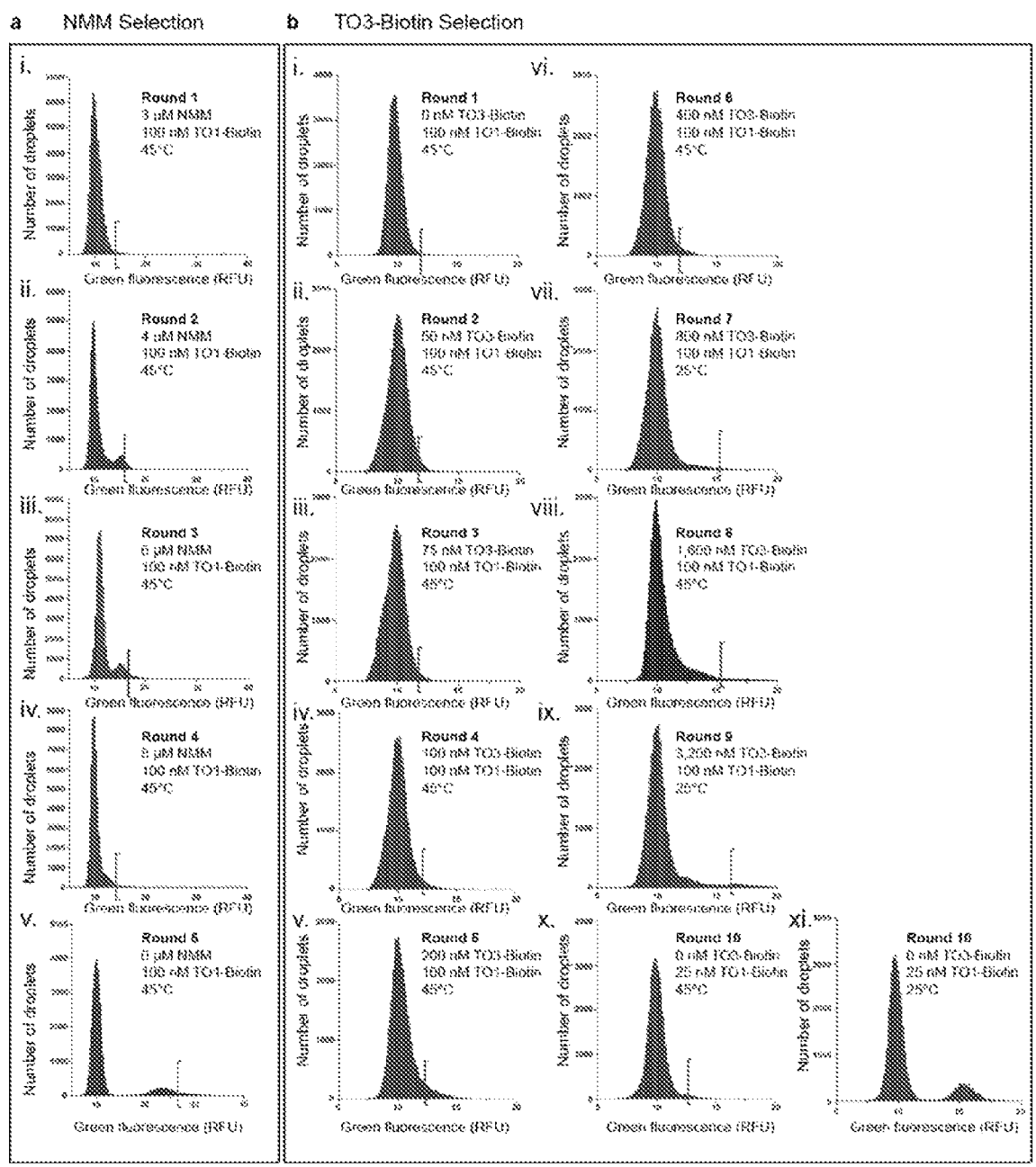
FIG. 5|Green fluorescence profile of the screenings performed in the presence of NMM and TO3-Biotin. (a) NMM. (b) TO3-Biotin. The green fluorescence of 50,000 droplets was used to build each profile. Red bars indicate the limit over which droplets were gated and sorted as positive. The selection conditions (TO1-Biotin and NMM/TO3-Biotin concentrations as well as the temperature of the analysis device) are indicated. In TO3-Biotin screening, b.xi corresponds to the same experiment as b.x but the fluorescence was recorded at 25° C.

A potential limitation of μIVC is the requirement of high TO1-Biotin concentrations (~100 nM), that would greatly exceed the Mango-I $K_D$ (~3 nM), and that could prevent the selection of high affinity aptamers. To mitigate this, we supplemented the in vitro transcription (IVT) mixture with TO1 competitors NMM (N-methyl mesoporphyrin IX) and TO3-Biotin, which are both known to interact with G-quadruplexes. The NMM supplemented IVT mixture significantly reduces TO1-Biotin/Mango-I fluorescence (FIG. 4). The NMM concentration was progressively increased during the first four screening rounds, therefore, any brightness increase at each round presumably resulted from the selection of brighter aptamers in the library which retaining high affinity and selectivity for TO1-Biotin (FIG. 1c). The RNA stability of the complex with TO1-Biotin was further challenged by sorting the droplets at 45° C. The relative fluorescence of the library increased 2.5-fold in the first round (~3 million variants analysed, Table 4), but it did not increase further over the later rounds (FIG. 1c, FIG. 5). However, the ability of NMM to compete against TO1-Biotin binding decreased progressively with each round (FIG. 6), indicating that the aptamers in the later rounds have higher affinity for TO1-Biotin.

TABLE 4

Metrics of screenings in presence of NMM

| Round | Temperature (° C.) | NMM (μM) | λ value | Fusion efficiency (%) | Number of analyzed droplets | Number of analyzed variants | Number of sorted droplets |
|---|---|---|---|---|---|---|---|
| 1 | 45 | 3 | 1.25 | 90 | 2,716,500 | 3,056,062 | 25,834 |
| 2 | 45 | 4 | 0.2 | 85 | 1,011,000 | 171,870 | 21,754 |
| 3 | 45 | 6 | 0.22 | 87 | 1,511,250 | 289,253 | 3,719 |

TABLE 4-continued

Metrics of screenings in presence of NMM

| Round | Temperature (° C.) | NMM (μM) | λ value | Fusion efficiency (%) | Number of analyzed droplets | Number of analyzed variants | Number of sorted droplets |
|---|---|---|---|---|---|---|---|
| 4 | 45 | 8 | 0.14 | 75 | 986,875 | 103,621 | 5,309 |
| 5 | 45 | 0 | 0.15 | 90 | 491,625 | 66,369 | 1,689 |

The last screening round shows that, in the absence of NMM, the fluorogenic properties of the enriched library remained unchanged (FIG. 1c). From the final enriched library, we cloned and sequenced 32 pool RNAs, and analysed their fluorogenic capacity (FIG. 7a, b). While the brightest clone was R5-NMM-20, six of the thirteen brightest aptamers exhibited an almost identical sequence to clone R5-NMM-5 (FIG. 7c).

In a second set of screenings, we increased the selection stringency by using the Mango-I specific competitor TO3-Biotin, which differs from TO1-Biotin by only two carbons in the methine bridge. To further increase the selection pressure for TO1-Biotin binding, we also decreased the RNA concentration in the droplets to 0.3 μM (from 8 μM with NMM). TO3-Biotin competitor was introduced in the second round of screening to ensure that positive droplets were not missed in the first round (FIG. 5b). In subsequent rounds, TO3-Biotin concentration was gradually increased (FIG. 1d and FIG. 6b and Table 4).

observed in the last rounds of selection. Accordingly, reverting the C66U mutation decreases the fluorescence of the aptamer/TO1-Biotin complex by ~44%. Finally, among the remaining clusters identified in the early rounds, cluster D, represented by R2-1, was found to have particularly high binding affinity.

Aptamer Structure and Function

Figure 2A:
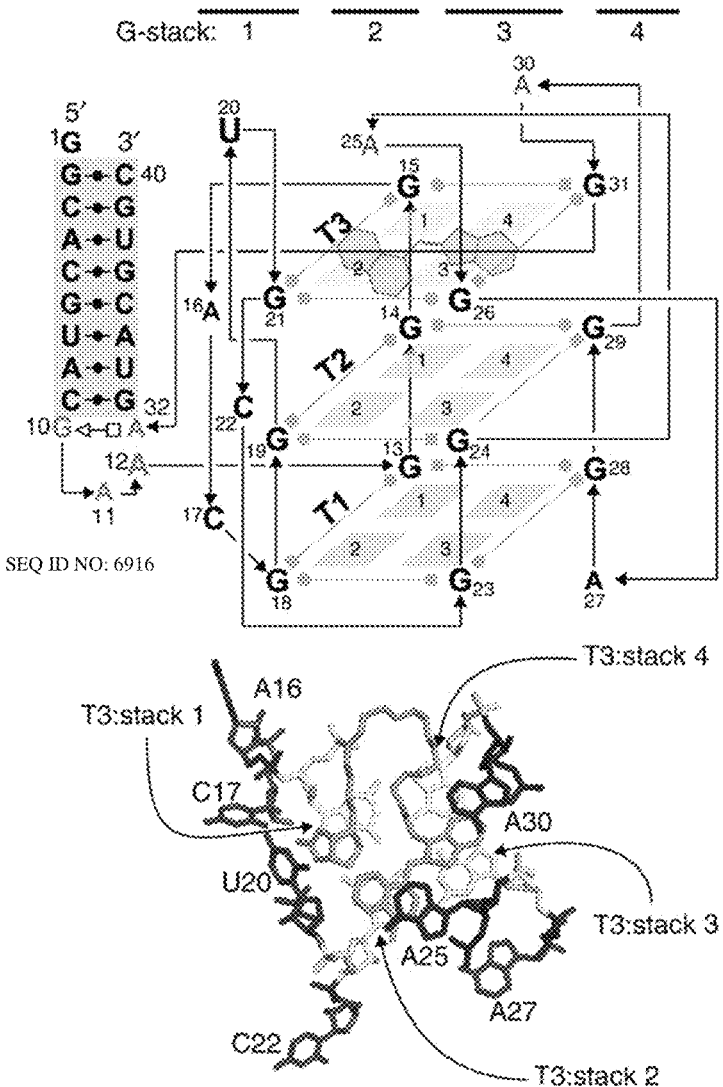
FIG. 2|RNA Mango I, II, III and IV core sequences and their properties. (a) Color coded alignment of RNA Mango I, II, III and IV. G residues in yellow are protected from DMS cleavage (data from panel d) when folded in the presence of fluorophore. Quadruplex stacks and their associated propeller sequences are numbered 1 through 4. The GAAA isolation motif of Mango I, together with two adenines essential for binding, are shown in green and red respectively. Purple shading represents a flanking stem region common for all four Mango aptamers. Schematic: A tertiary structure schematic of Mango I, showing tier 1, 2 and 3 of its quadruplex structure (T1, T2 and T3) and color-coded as in (a). TO1-Biotin is shown in green. Bottom: Top view of the Mango I core (PBD ID: 5V3F), showing the T3 tier of the quadruplex and relevant propeller residues, color coding matches the schematic and panel a. (b) Fluorescence binding curves for each Mango aptamer determined by titrating RNA aptamer concentration while holding TO1-Biotin fluorophore constant at 10 nM. $K_D$ values are shown next to each titration. (c) Same as for panel b but using 20 nM TO3-Biotin. Data for panels b and c have been normalized such that Mango I has a maximum fluorescence of 1. Error bars are standard deviation of three replicates. (d) DMS chemical protection patterns for the four Mango aptamers. 3' end-labelled RNA (terminal $^{32}$pCp shown as a black asterisk) was subjected to DMS chemical modification followed by reduction by $NaBH_4$ and aniline cleavage as described in the methods. RNA sequences are displayed to the right of each set of lanes with stem portions represented as purple blocks. Legend: T1—denatured T1 ladder; OH—partial alkaline hydrolysis ladder; (−) DMS—denatured reaction with dd$H_2$O added in place of DMS; 80° C. DMS—denatured DMS ladder; remaining lanes are native DMS reactions with addition of potassium to 140 mM final (+KCl), addition of sodium to 140 mM final (+NaCl), with or without 500 nM TO1-Biotin (+TO1-Biotin). Red asterisk indicates a notably unprotected G. Red daggers in Mango II and Mango IV indicate nucleotides that favor looping out of the core before returning with a G that participates in completing the first G stack (in contrast to Mango I that prefers three Gs in a row for a stack).
Figures 2B, 2C, 2D:
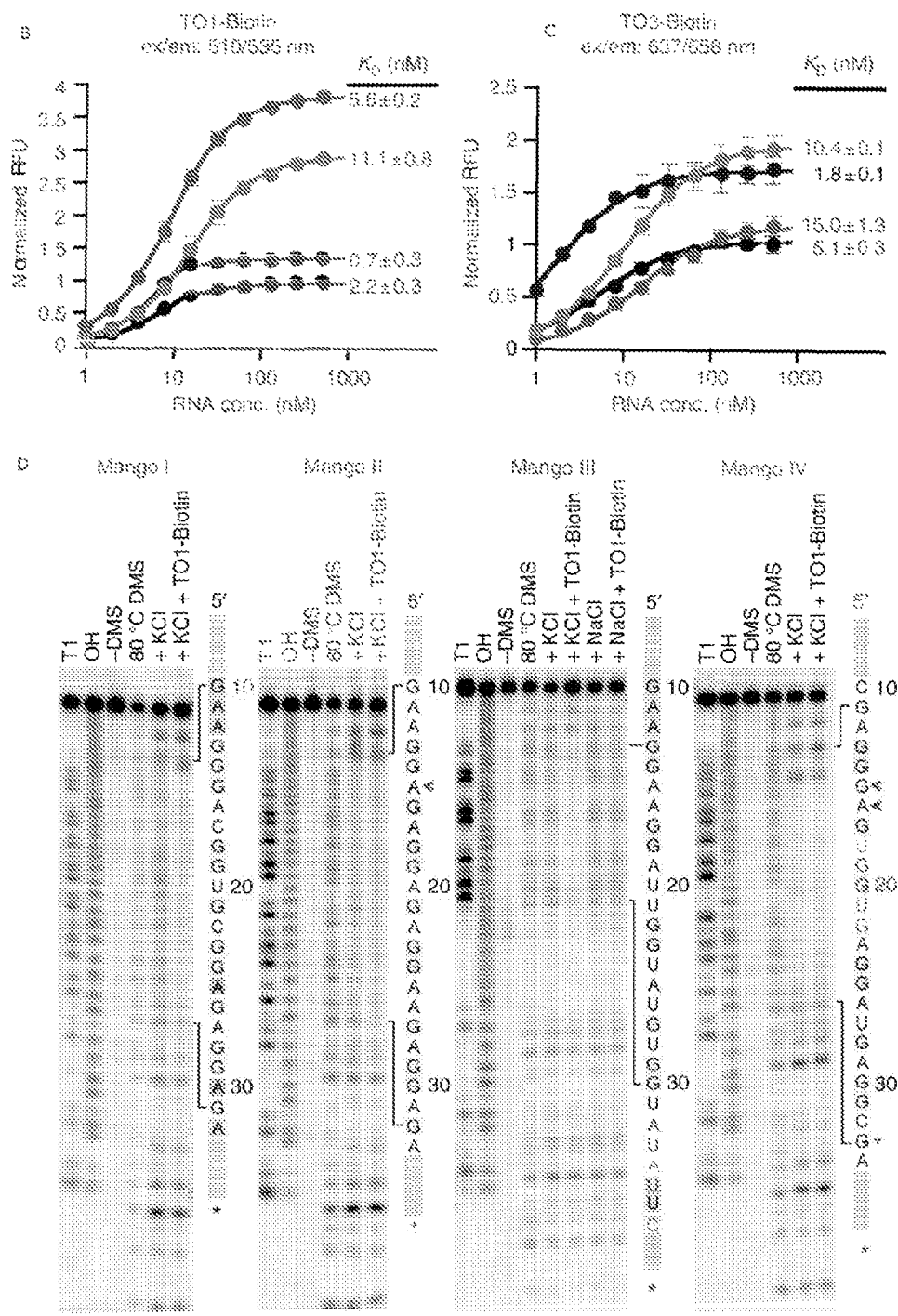
Figure 8:
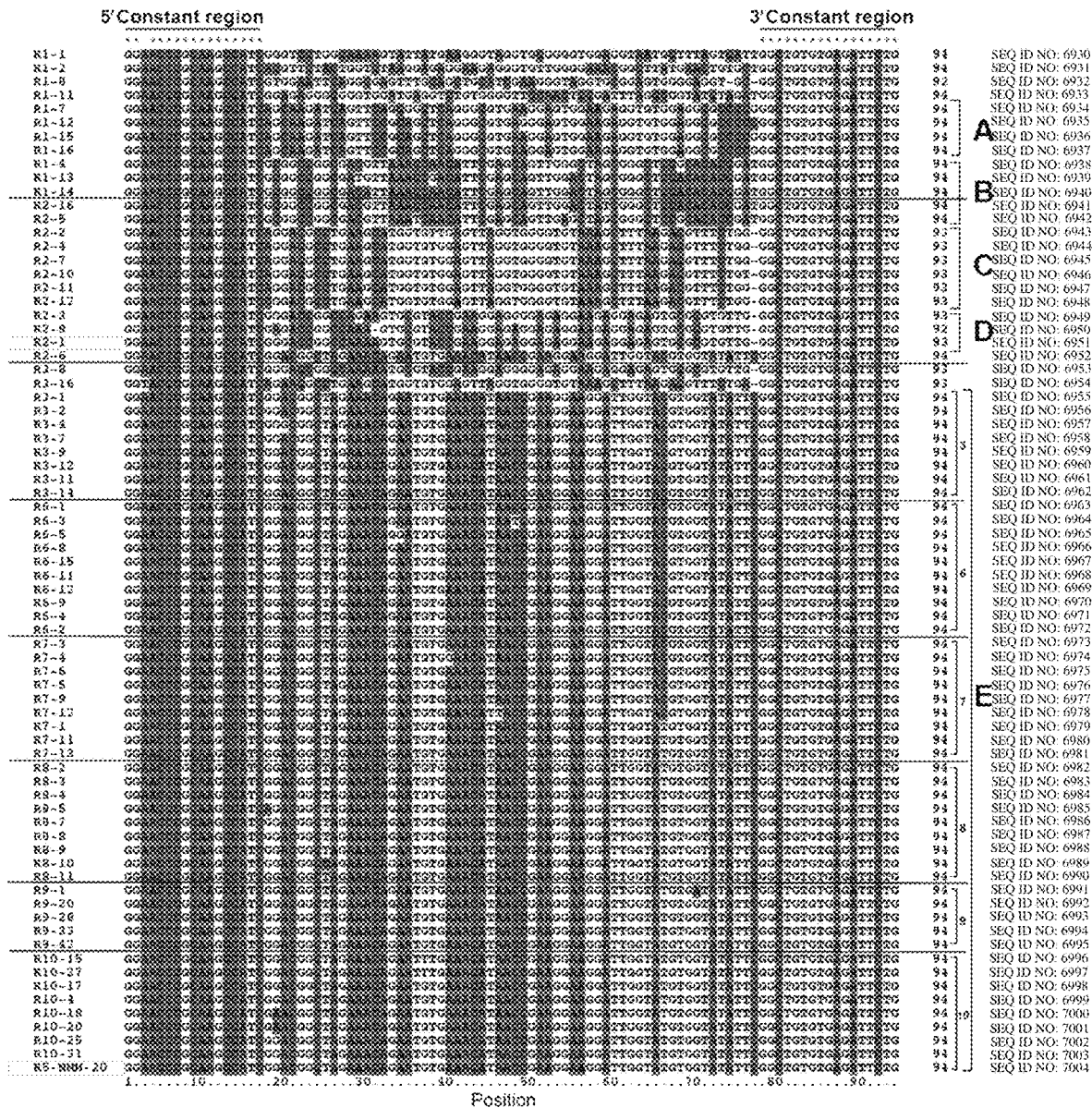
FIG. 8|Sequence analysis of the variants isolated across the rounds of screening performed in the presence of TO3-Biotin. The first green box indicates Mango II (R2-1). For comparison, the sequence of Mango III (R5-NMM-20) was also added and boxed in green. The families of sequences clustering together are labelled (A to E).

Based on the parental sequence isolates R2-1, R5-NMM-20 and R5-NMM-5 (FIGS. 6, 7 & 8), we engineered the minimal reference constructs Mango-II, Mango-III and Mango-IV (FIG. 2a), respectively, by truncation and sequence manipulation while maintaining the binding and fluorescent properties of the parental constructs (FIG. 9). Mango-II, III and IV were found to be 1.5-, 4- and 3-fold brighter than Mango-I, respectively (FIG. 2b). Mango-II binds TO1-Biotin with subnanomolar affinity, while Mango-III and IV had slightly weaker affinities than Mango-I (FIG. 2b). These constructs also demonstrated improved fluorescence response when bound to TO3-Biotin relative to

TABLE 5

Metrics of screenings in the presence of TO-3

| Round | Temperature (° C.) | T0-3 (nM) | T0-1 (nM) | λ value | Fusion efficiency (%) | Number of analyzed droplets | Number of analyzed variants | Number of sorted droplets |
|---|---|---|---|---|---|---|---|---|
| 1 | 45 | 0 | 100 | 1.25 | 95 | 2,328,630 | 2,765,248 | 4,607 |
| 2 | 45 | 50 | 100 | 0.2 | 80 | 1,106,750 | 177,080 | 8,328 |
| 3 | 45 | 75 | 100 | 0.15 | 94 | 1,019,990 | 143,818 | 6,446 |
| 4 | 45 | 100 | 100 | 0.2 | 95 | 1,002,500 | 190,475 | 11,478 |
| 5 | 45 | 200 | 100 | 0.17 | 90 | 1,044,500 | 159,808 | 12,205 |
| 6 | 45 | 400 | 100 | 0.25 | 85 | 1,015,880 | 215,874 | 8,779 |
| 7 | 25 | 800 | 100 | 0.2 | 79 | 1,087,500 | 195,750 | 8,463 |
| 8 | 45 | 1,600 | 100 | 0.26 | 88 | 768,250 | 175,775 | 4,729 |
| 9 | 25 | 3,200 | 100 | 0.28 | 75 | 547,250 | 114,922 | 5,868 |
| 10 | 45 | 0 | 25 | 0.15 | 70 | 499,500 | 52,447 | 4,004 |

In round 1, the relative fluorescence of the population increased, but it decreased upon addition of competitor (Round 2, FIG. 1d). In subsequent rounds, the relative fluorescence increased progressively until the TO3-Biotin concentration exceeded TO1-Biotin by 32-fold (3.2 μM and 100 nM, respectively). The final round shows that the enriched library maintains its florescent properties in the absence of competitor. RNA molecules from each of the final rounds were cloned and sequenced. Further characterization of the different libraries indicates that aptamers were first selected for their capacity to discriminate TO1-Biotin from TO3-Biotin (FIGS. 6b and c). Surprisingly, we found that, starting from round 3, the libraries were dominated by a single cluster of sequences (cluster E, FIG. 8) that was attributed to the TO3-resistant aptamers discussed above. In the last four rounds, this sequence was progressively replaced by the point mutant C66U; best represented by the aptamer R10-15. The progressive domination by R10-15 was likely at the origin of the fluorescence improvement Mango-I while exhibiting nanomolar binding affinities to this strongly red shifted fluorophore (FIG. 2c). Notably, the brightness of the Mango-III and Mango-IV TO1-Biotin bound complexes are 43,000 $M^{-1}cm^{-1}$ and 32,000 $M^{-1}cm^{-1}$, respectively, making Mango-III 1.3 times brighter than enhanced GFP (EGFP) a common benchmark for the characterization of improved fluorescent proteins.

Mango-II has a distinct flurophore binding mode from that of Mango-I. Crystallography shows that Mango-I consists of a three-tiered G-quadruplex core that binds TO1-Biotin by sandwiching it between the T3 layer of the G-quadruplex and A25 and A30 (FIG. 2a). This fluorophore binding core is isolated from an arbitrary RNA duplex (FIG. 2a, purple residues) by a novel GAAA tetraloop like adapter (FIG. 2a, blue residues). Like Mango-I, the Mango-II and IV aptamers function in the presence of a closing stem (FIGS. 2 & 9). DMS probing, which correctly confirmed the three-tiered quadruplex structure of Mango-I, indicated that Mango-II also contains a three-tiered quadruplex structure (FIG. 2d). In distinct contrast to Mango-I this aptamer appears to have looped out its A15 and has an adenine dinucleotide in its third propeller loop. This single A25 adenine found in these region of Mango-I is stacked on top of the methylquinone heterocycle of the TO1-Biotin implicating an important functional role in this sequence change in Mango-II. Indeed either of these changes either individually or together were shown to play an important role in the improved affinity and brightness of Mango-II (FIG. 9b).

Mango-IV, while superficially similar to both Mango-I and Mango-II based on primary sequence (FIG. 2a), surprisingly lacked N-7 protection at residue G15. This residue in Mango-I plays an important role in forming strand 1 of the T3 quadruplex tier and is fully DMS protected in Mango-I (FIG. 2a,d). Further, Mango-IV lacked DMS protection of residue G33, which in Mango-I plays an instrumental role in forming the T3 G-quartet and that is DMS protected in Mango-II. In addition the GAAA linker motif of Mango-I, that is apparently also present in Mango-II was not found in Mango-IV, with CGA being found before the first quadruplex tier of Mango-IV. Replacing the CGA of the Mango-IV sequence with GAA resulted in a four-fold decrease in binding affinity, suggesting a new role for this sequence element. This data supported by additional point mutational analysis (FIG. 9) indicates that the detailed folds of both Mango-II and Mango-IV are not only considerably different from each other but also Mango-I in the T3 region of the Mango-I fold (FIG. 2a).

The folding of the presently disclosed constructs was characterized further by examining their salt dependence, thermal melting properties, and CD spectra. Both Mango-II and IV have Hill coefficients and affinities for potassium similar to Mango-I (FIG. 10), and while Mango-I and Mango-II did not fluoresce appreciably in the presence of sodium ions, Mango-IV showed a limited fluorescence response. Most notably these aptamers in the presence of potassium were significantly resistant to high levels of $Mg^{2+}$ (256 mM) whereas Mango-I fluorescence was strongly inhibited at such concentrations indicating that Mango-II and Mango-IV were substantially more stably folded than Mango-I. Consistent with this, the DMS protection patterns of these aptamers (FIG. 2d) were largely invariant in the presence or absence of TO1-Biotin. In addition, Mango-II and Mango-IV have $A_{260}$ thermal melts that change little in the presence or absence of TO1-Biotin (FIG. 11). This is in distinct contrast to the thermal melt of Mango-I, which changes significantly upon presence or absence of TO1-Biotin. Consistent with the formation of a G-quadruplex structure in Mango-I, II, and IV the ligand bound CD spectra for each aptamer were quite similar (FIG. 12).

Figure 10:
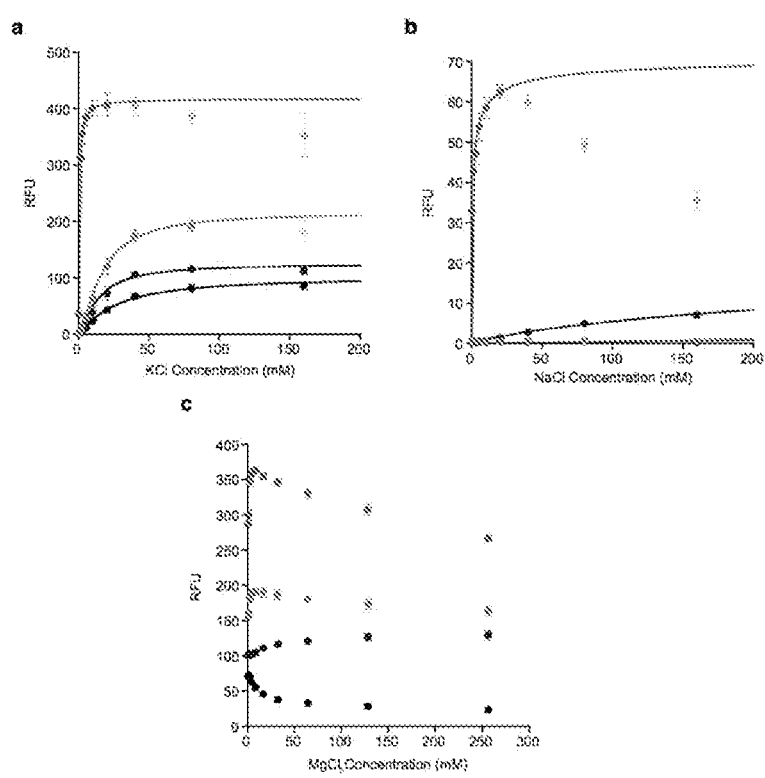
FIG. 10|Salt dependence of new Mango variants. Dependence of fluorescence of each Mango for (a) $K^+$, (b) $Na^+$ in place of $K^+$, and (c) $Mg^{2+}$ ions in a buffer containing 140 mM $K^+$. Each salt was titrated holding 25 nM RNA and 50 nM TO1-Biotin constant. 10 mM Tris buffer (pH 7.2) was used in place of phosphate of the WB buffer to avoid monovalent counter ions. Color-coding is as follows: Black—Mango I, Blue—Mango II, Green—Mango III, Orange—Mango IV. When possible, data is fitted to the Hill equation and Hill coefficients are listed in Table 1. Hill coefficients are fitted to dark points. Points in lighter shade have been excluded from the fit. Error bars are standard deviations of three replicates.

Mango-III, the brightest of the three exemplified aptamers was considerably different from the other three Mangos. Unable to form a three tiered G-quadruplex even in principle due to the presence of only nine guanines in its core, these guanines where, nevertheless found to be well protected from DMS (FIG. 2d) and a variety of evidence in addition to DMS probing indicates that they form a distinctly different two tiered quadruplex core in Mango-III. Mango-III contains much longer A/U rich propeller regions than any of the other Mangos exemplified herein (FIG. 2a) and has a fluorescence response to potassium and sodium that had a dramatically higher affinity (~two order of magnitude), while being only modestly inhibited by high levels of magnesium (FIG. 10). Its sigmodial fluorescent melting curve strongly resembles the melting of RNA Spinach and not the more linear melting curves observed for Mango-I, II and IV (FIG. 11). Similarly the CD spectra of the bound Mango-III complex is distinctly different in the 270-300 nm region from the other Mango constructs, indicative of a G-quadruplex structure distinct from that found in Mango-I (FIG. 12). Mango-III lacked an excitation shoulder found to be in common for all the other Mango constructs in the 270-300 nm region (FIG. 13), this and other differences in the excitation and emission spectra indicate that Mango-III has a motif significantly different from the other Mango aptamers exemplified herein.

Cellular Imaging of Mango Tagged RNAs

To demonstrate the efficacy of the exemplified aptamers in cellular imaging, we tagged the well characterized human 5S ribosomal RNA with each Mango variant by incorporating them into an F30 folding scaffold (FIG. 14a, Table 5) previously shown to improve cellular fluorescence. Each Mango tagged 5S RNA, with or without the folding scaffold or terminator hairpin, exhibited comparable fluorescence intensities in vitro (FIG. 14b). No appreciable fluorescence was observed with Mango mutants or in the absence of Mango RNA or TO1-Biotin fluorophore.

Figures 3A, 3B, 3C:
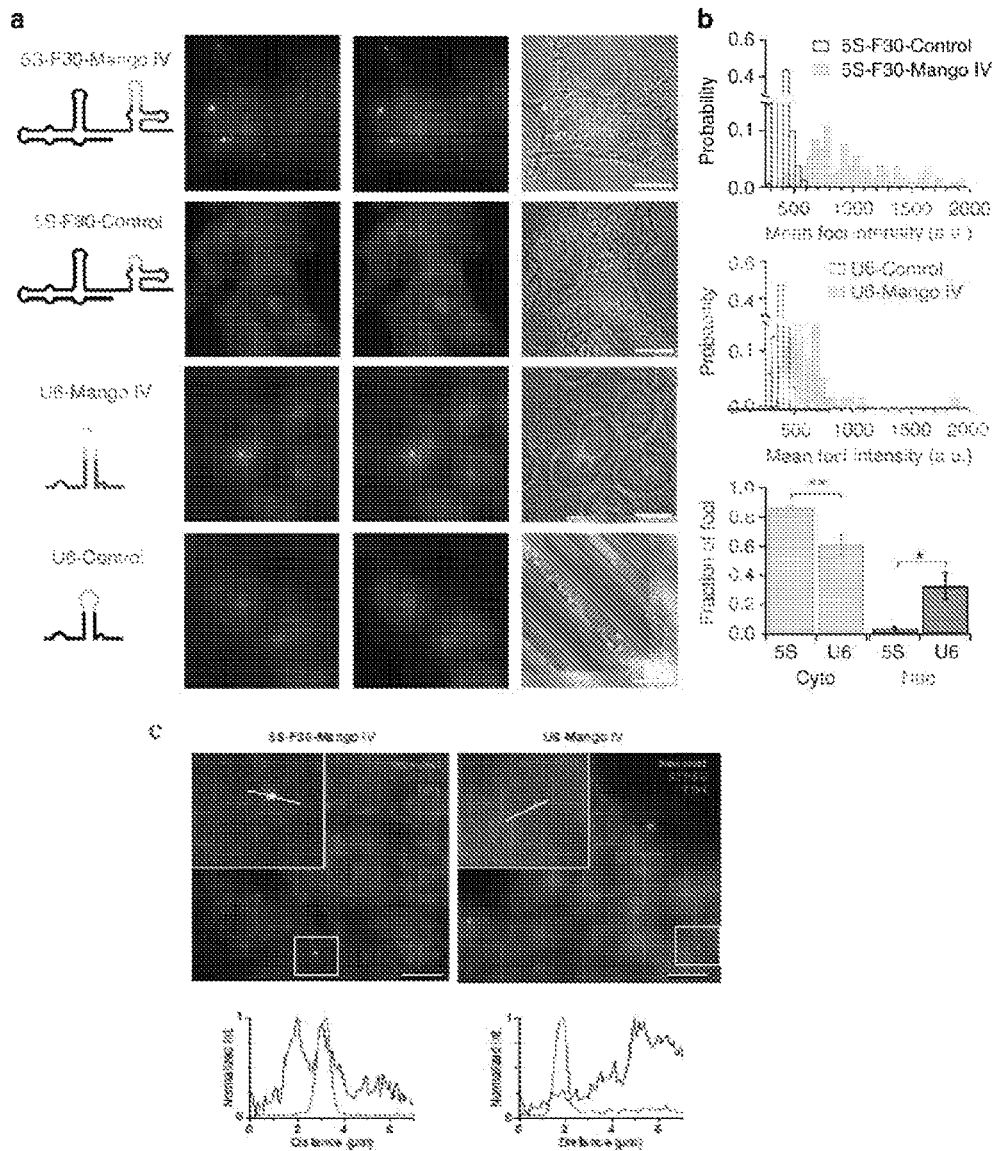
FIG. 3|Cellular imaging of Mango IV tagged RNAs. (a) Maximum projections of fixed cells containing Mango IV tagged 5S and U6 RNAs stained with 200 nM TO1-biotin (Yellow) and 1 mg/ml Hoechst 33258 (Blue). (b) Mean intensity distributions of 5S-Mango IV and U6-Mango IV Foci (Yellow) compared to controls (Black). Fraction of foci observed in the cytoplasm and nucleus for 5S and U6-Mango IV RNAs (bottom panel, * denotes p<0.05 and ** means p<0.01). (c) Cytoplasmic 5S-Mango IV foci localize with immunostained mitochondria (ATP5B), whereas cytoplasmic U6-Mango foci do not. Normalized fluorescence intensities as a function of distance along the inset white lines (bottom panels). (d) Localization of 5S-Mango IV and U6-Mango IV relative to immunostained Ribosomes (RP-S6), Mitochondria (ATP-5B) and snRNPs (LSm3). (e) Localization of 5S-Mango IV and U6-Mango IV foci relative to immunostained P-Bodies (GW182), Endosomes (EEA-1) and Stress Granules (TIA-1). Scale bars are 10 μM. All images are maximum projections except in c, which show a single focal plane.

To image the tagged RNA, we transfected in vitro transcribed 5S-F30-Mango RNAs into HEK293T cells, fixed the cells on ice with formaldehyde and stained with TO1-Biotin. This protocol being based on the surprising finding that in vitro, Mango-I, II and IV fluorophore-aptamer complexes were substantially resistant to formaldehyde at room temperature (FIG. 15). Up to ~10 bright RNA Mango foci could be readily detected per cell with a fluorescence microscope, but not in control transfections (FIG. 3a). A time course of this process (FIG. 16a) shows the initial delivery of lipofectamine particles to the cell membrane (5 min after transfection), followed by dispersal of the RNA in the cytoplasm (15-30 min) and foci formation (30-60 min). Contrary to 5S-F30-Mango-I, II and III, transfections with 5S-F30-Mango-IV RNA consistently exhibit visible foci (FIGS. 16 & 17), indicating that Mango-IV folds correctly both in the presence and absence of TO1-Biotin, unlike the others (FIG. 11). The mean intensity of the 5S-F30-Mango-IV foci is two to three-fold higher than the 5S-F30-Control background (FIG. 3b and FIG. 17). The majority of 5S-F30-Mango IV foci (~85%) are cytoplasmic, a small fraction (~5%) are clearly nuclear, and the remaining foci appeared on the nuclear boundary.

Figures 3D, 3E:
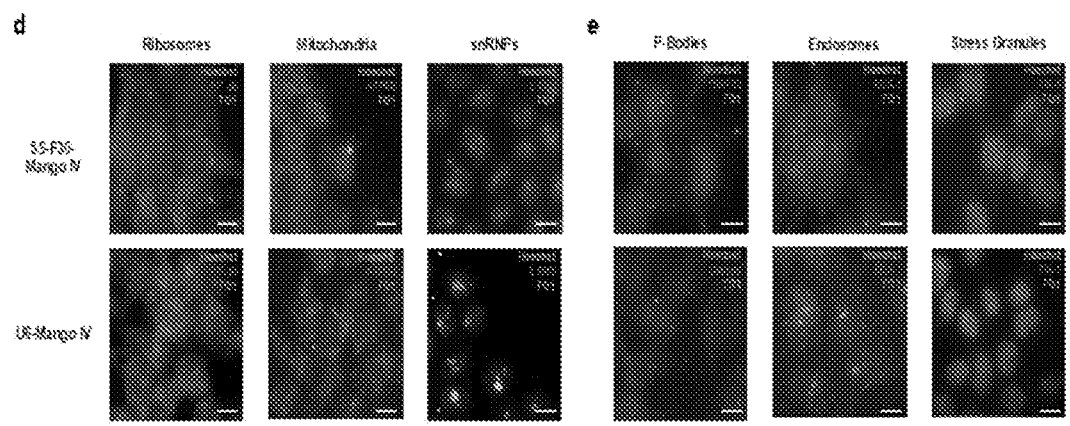

To illustrate the sub-cellular localization of the 5S-F30-Mango IV foci, we combined Mango imaging with immunostaining, which is made feasible by the ability of Mango-IV to withstand formaldehyde fixation. It has been shown that 5S rRNA is imported into mitochondria to facilitate the translation of mitochondrial proteins. Cytoplasmic 5S-Mango IV foci clearly overlap with immunostained mitochondria (FIG. 3c). Cytoplasmic 5S-Mango IV foci also overlap with antibody staining against the Ribosomal Protein S6 (RP-S6, FIG. 3d). Conversely, we do not observe overlap with other sub-cellular compartments, such as P-bodies, Endosomes or Stress Granules, where the transfected RNA could be processed for degradation (FIG. 3e).

To confirm that the observed foci are specific, we tagged and transfected an RNA that localizes to a different cellular compartment. The U6 snRNA (small nuclear RNA) is expected to associate with snRNP (Ribonuclear Protein) complexes in the nucleus. We tagged U6 snRNA by incorporating Mango-IV directly into an internal stem loop (FIG. 14). The resulting construct exhibits comparable fluorescence intensity to Mango IV alone in vitro (FIG. 14). Direct transfection of U6-Mango-IV snRNA yields fluorescent foci comparable to 5S-F30-Mango-IV (FIG. 3a), albeit with lower intensity (FIG. 3b). The fraction of nuclear foci increased ~9-fold, while cytoplasmic foci decrease significantly (p<0.01, FIG. 3b). As opposed to 5S-F30-Mango-IV, cytoplasmic U6-Mango-IV foci did not overlap with mitochondria (FIG. 3c) or ribosomes (FIG. 3d), whereas nuclear U6-Mango-IV foci overlap with snRNP protein Lsm3 (FIG. 3d), as expected. Similar to 5S-F30-Mango-IV, U6-Mango-IV foci do not overlap with other sub-cellular compartments, such as P-bodies, Endosomes or Stress Granules (FIG. 3e). Interestingly, we observe a diffuse signal above background in the nucleolus, which may correspond to freely diffusing U6-Mango IV molecules (FIG. 3a,d and FIG. 18).

Taken together, these fixed cell data show that Mango-IV, and other aptamers disclosed herein, can be used to label and image small cellular RNAs via direct transfection of in vitro transcribed RNAs, without affecting their expected sub-cellular localization. Finally, to illustrate that Mango-tagged RNA molecules can be imaged in live cells, we took advantage of the aptamer's high affinity for TO1-Biotin, and transfected in vitro transcribed 5S-F30-Mango-IV RNA pre-incubated with TO1-Biotin. After transfection the cells exhibit bright foci similar to those observed in FIG. 3a, with lower background fluorescence than observed in fixed cells (FIG. 16b). The foci can be readily tracked revealing three distinct diffusive behaviors: fast, slow and static (FIG. 16b). No such foci were observed in experiments with the 5S-F30-Control. Overall, these results demonstrate that fluorogenic Mango RNA aptamers are a versatile tool to image small cellular RNAs in fixed and live cells.

To estimate the number of fluorescent 5S-F30-Mango IV molecules in each foci, we performed photobleaching-assisted microscopy on fixed cells. A maximum likelihood estimate analysis of the photobleaching trajectories[27,28], revealed between 4 and 17 photobleaching steps per foci. In addition, the photobleaching step distribution reveals two peaks corresponding to either one or two molecules. The number of observed steps correlates linearly with the initial foci intensity below 2,000 intensity units. Altogether, these results indicate that each foci contains at least 4 to 17 fluorescent molecules, consistent with the observed range of experimental intensities, and raises the interesting possibility of imaging single molecules in live cells.

Finally, to test whether the new Mangos have the ability to function as genetically encoded tags expressed in cells, we constructed plasmids that express the 5S rRNA under the control of a RNA pol III promoter in conjunction with a mCherry reporter gene to identify successfully transfected cells (FIG. 43a). Upon fixation, we observed that cells expressing the pSLQ-5S-F30-Mango II and IV constructs exhibit an increased fluorescent signal in nucleolar compartments as well as forming distinct cytoplasmic foci when compared with the pSLQ-5S-F30-Control construct (FIG. 43a). The analysis of the peak Mango and mCherry intensities for multiple cells expressing the pSLQ-5S-F30-Mango II plasmid shows a population of cells with a high Mango specific signal, not seen in cells expressing the pSLQ-5S-F30-Control plasmid (FIG. 5b). Interestingly, we observe that cells exhibiting lower mCherry intensities can also show higher Mango signal, consistent with RNA transcription preceding mCherry translation. In agreement with this, reducing plasmid expression time, from 24 to 12 h, increased the number of observed cytoplasmic foci. Under the same conditions of fixation and staining, signal was not observed in untransfected cells or in cells expressing the 5S-F30-Broccoli construct. The robust cytoplasmic signal observed after 12 h of pSLQ-5S-Mango IV expression enabled us to combine Mango imaging with immunofluorescence (FIG. 43c). As expected, the observed Mango foci co-localize significantly with Ribosomal Protein L7. However, no significant co-localization was observed with the mitochondrial stain ATP5B. The absence of co-mitochondrial localization, in this case, is likely due to the fact that most nucleolar expressed 5S rRNA will assemble into ribosomes in the nucleus, whereas 5S rRNA molecules transfected directly in the cytoplasm will not, and are more readily available for mitochondrial import. The observed cytoplasmic foci did not co-localize with immunostaining for stress granules, P-bodies or endosomes.

To confirm that the observed 5S rRNA foci are specific, we expressed a Mango II tagged small Cajal-body specific RNA (mgU2-47) that mediates the 2'-O-methylation of the U2 snRNA[29]. Upon expression, the Mango tagged mgU2-47 RNA formed well defined nuclear foci that were absent in the mgU2-47 Control RNA (FIGS. 43a and b). The nuclear foci also co-localized with immunostained Cajal-bodies (FIG. 43c). Taken together these results demonstrate the ability of Mango tags to function as efficient genetically encoded reporters of RNA sub-cellular location.

The photobleaching properties of Mango I and Mango IV were superior to RNA Spinach with bleaching half-lives 10 times longer on average under identical illumination conditions (FIG. 16 d&e).

Bipartite Aptamer Systems

In the X-Ray crystal structure of Mango I, the 'GAA^A' tetraloop motif, with 'GAA' on the 5' end of the G quadruplex core (represented by ^) and the remaining 'A' on the 3' end of the core, separates two phosphates juxtaposed at the end of the core by 8 Å. We recognized that this 8 Å separation is important for fluorescence enhancement with select embodiments of RNA Mangos, with the G quadruplex in configuration for ligand binding. We have recreated this conformation in what are designated herein as bipartite embodiments, involving the complementary base pairing of portions of the Mango aptamers to an RNA target. In embodiments of this kind, the Mango aptamer acts as a switch, with fluorescence being switched on by binding to the target, which may accordingly be called a 'trigger'. This is schematically illustrated in FIG. 20.

FIG. 20 shows various Mango I switches and triggers initially tested, illustrating that in these select embodiments Mango switches with two A residues in the GAA' A' tetraloop motif, an A being on the either side of the G-quadruplex core, gave maximal response to the binding of the trigger RNA. We also illustrate that those triggers which are continuously complementary to the bait regions, without any intervening gap of unpaired bases, to be optimal for fluorescence.

To illustrate a functional bipartite system, we used β-actin mRNA from mouse embryo fibroblasts as a model. β-actin mRNA, because of its Zipcode region binds to Zipcode Binding Protein (ZBP) which then binds to cytoskeleton proteins for transport to the leading edges of lamellipodia in growing fibroblasts (FIG. 22A). We developed RNA Mango constructs that target β-actin mRNA in a target region which has previously been shown not to interfere with the localization. We developed another RNA Mango construct that targets the Zipcode binding region, which when targeted causes delocalization of β-actin m RNA.

To quantitatively compare bipartite constructs, we measured the difference in RFU between bound and unbound Mangos, providing a contrast ratio of bound to unbound fluorescence, reflecting the increase in fluorescence upon binding of the bipartite construct to the target in the presence of the fluorophore. Higher contrast reflects lower background, and thus higher signal to noise ratio. For instance, in the Mango I based bipartite construct targeting β-actin mRNA in the target region 1087-1121, the equilibrium RFU after the addition of TO1-Biotin to the Mango construct is 3 (point a in FIG. 22B), after adding the target it increased to 321 (point b in FIG. 22B), a contrast of ~110. In the same manner the contrast for the Mango construct targeting the zipcode region (2955-2990) of β-actin, is ~80.

The Mango II core sequence was used to prepare alternative bipartite constructs that include an inhibitory stem, a sequence that is part of the aptamer that binds to a portion of the core sequence, thereby inhibiting core formation in the absence of binding to a target. Surprising, as illustrated in FIG. 23, we found that the addition of an inhibitory stem not only decreased fluorescence in the absence of the trigger, but also resulted in increased total fluorescence upon the addition of the trigger.

The length of the inhibitory stem may be adjusted in alternative embodiments. If the stem length is too short, it may not adequately destabilize the G-quadruplex, thus decreasing the contrast. If the stem length is too long, then the inhibited structure, with the stem bound to the core, may become so stable that it inhibits or delays folding of G-quadruplex upon trigger binding. In exemplary embodiments, we illustrate optimization of inhibitory stem length in Mango II constructs. Increasing the inhibitory arm length by increments of one nucleotide revealed that an inhibitory arm containing five nucleotides gave high contrast with minimal decrease in the rate of fluorescence increase (FIG. 24). A Mango bipartite construct, as illustrated in FIG. 25, has three parts:

1) RNA mango core (i)—comprised of aptamer sequence that binds to TO1-B and becomes fluorescent;
2) An inhibitory arm (ii)—comprised of regions complementary to the RNA Mango so that it binds and destabilizes RNA Mango core in the absence of a 'trigger' RNA, decreasing fluorescence in the absence of the RNA of interest;
3) Bait (iiia, iiib and iiic)—comprised of one or more regions, which are complementary to the RNA of interest, sequence depending upon RNA of interest.

An alternative bipartite embodiment was prepared based on a Mango IV core sequence. A variety of constructs were tested (FIG. 26), with a range of results (FIG. 27) found.

A variety of bipartite Mango constructs were exemplified in vivo via transfection into MCF7 cells. In these embodiments, the sequences shown in FIG. 28 were used to probe for beta actin mRNA, with the exception of MII.O4, which acted as a non-hybridizing control. TO1-Biotin was introduced into the media, exemplifying the fact that it is cell permeable. FIG. 29 and FIG. 30 illustrate the time course of fluorescence for these bipartite Mango switch probes.

Unimolecular Mango III Rolling Circle Amplification

Early transcription assays revealed that the mango constructs are capable of displaying fluorescence enhancement in T7 transcription buffer supplemented with potassium to a final of 140 mM (FIG. 31). This illustrates that in select embodiments Mango aptamers may be used for detection of nucleic acids in a two-step fluorescence-based detection system using the Mango aptamers as the reporter. For example, using a conventional rolling circle amplification method as a first step, transcription in step two produces multiple copies of the Mango aptamer, which in turn bind TO1-biotin and progressively enhances fluorescence. Nucleic acid concentration can be discerned by a simple fluorescence reading. In these assays, the Mango III fluorescence emerged rapidly upon the addition of the RNA polymerase (FIG. 32). Sensitivity down to 5 nM was easily demonstrated without optimization and operating all enzymes isothermally at room temperature (FIGS. 33 & 34).

Fluorophores

A variety of flurophores may be used in alternative aspects of the presently disclosed compositions and processes. For example, U.S. Pat. No. 4,883,867 describes fluorometric assays for ribonucleic acids that use dyes having Formula I:

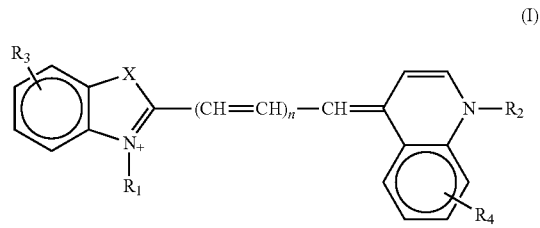

Wherein:
X=O, S, Se, or $C(CH_3)_n$,
=alkyl having from 1-6 carbons;
$R_2$=alkyl having from 1-6 carbons;
$R_3$=fused benzene, alkyl having 1-6 carbons, methoxy or H;
$R_4$=alkyl having 1-6 carbons, methoxy or H; and
n=zero or an integer from 1-6.

Alternative embodiments disclosed therein include compounds wherein:
$R_1$=$CH_3$, $R_2$=$CH_3$, $R_3$=H, $R_4$=H, X=S, and n=1; or,
$R_1$=$CH_3$, $R_2$=$CH_3$, $R_3$=fused benzene, $R_4$=H, X=S, and n=0; or,
$R_1$=$CH_3$, $R_2$=$CH_3$, $R_3$=H, $R_4$=H, X=O, and n=0; or,
X=O, S, Se or $C(CH_3)_2$, $R_1$=alkyl having from 1-6 carbons, $R_2$=alkyl having from 1-6 carbons, $R_3$=fused benzene, alkyl having 1-6 carbons, methoxy or is hydrogen, $R_4$=alkyl having 1-6 carbons, methoxy or H; and n=0 or an integer from 1-6; or,
$R_1$=$CH_3$, $R_2$=$CH_3$, $R_3$=H, $R_4$=H, X=S, and n=1; or,
$R_1$=$CH_3$, $R_2$=$CH_3$, $R_3$=fused benzene, $R_4$=H, X=S, and n=0; or,
$R_1$=$CH_3$, $R_2$=$CH_3$, $R_3$=H, $R_4$=H, X=O, and n=0.

In U.S. Pat. No. 4,883,867, Thiazole Orange (TO1) is identified as the compound of Formula I where $R_1$=$R_2$=$CH_3$; $R_3$=$R_4$=H, X=S and n=0. As such, TO1 is an asymmetric cyanine fluorophore, which contains a benzothiazole ring covalently linked to a quinoline ring via a monomethine bridge. In aqueous solution the fluorophore exhibits very low fluorescence ($\lambda_{ex}$=500 nm, $\lambda_{em}$=525 nm, $\phi$=2×10$^{-4}$) due to rapid nonradiative decay through the torsional motion in the monomethine bridge joining the two heterocycles. Normally, TO1 becomes strongly fluorescent when the monomethine bridge connecting the two heterocycles is rigidified through nonspecific insertion into double-stranded helical nucleic acids giving a fluorescence quantum yield of 0.11. TO1 is characterized by: small size, lack of toxicity, plasma and nuclear membrane permeability, short intracellular half-life, and the accessibility of a broad wavelength range via simply synthesized TO1 analogues.

In the examples disclosed herein, it has been shown that a very wide variety of substituents may be present at $R_1$ in compounds of Formula I, for example comprising one or a combination of, substituted or unsubstituted: alkenyl, halogen (e.g., fluorine, chlorine, bromine, iodine, etc.), hydroxyl, alkoxy (e.g., methoxy, ethoxy, perchloromethoxy, perfluoromethoxy, etc.), alkylcarbonyloxy, alkyloxycarbonyl, arylcarbonyloxy, arylcarbonylamino, alkoxycarbonylamino, al koxycarbonyloxy, aryloxycarbonyloxy, carboxylate, alkylcarbonyl, alkylaminoacarbonyl, arylalkyl aminocarbonyl, alkenylaminocarbonyl, alkylcarbonyl, arylcarbonyl, aminoalkyl, arylalkylcarbonyl, alkenylcarbonyl, alkoxycarbonyl, silyl, aminocarbonyl, alkylthiocarbonyl, phosphate, aralkyl, phosphonato, phosphinato, cyano, amino, acylamino, amido, imino, sulfhydryl, alkylthio, sulfate, arylthio, thiocarboxylate, alkylsulfinyl, sulfonato, sulfamoyl, sulfonamido, nitro, cyano, azido, heterocyclyl, alkylaryl, aryl and heteroaryl substituents. The $R_1$ group of Formula I may accordingly be substituted with any substituent which allows the fluorophore compound to perform its intended function.

In alternative embodiments, fluorophores for use as disclosed herein may include compounds of Formula II:

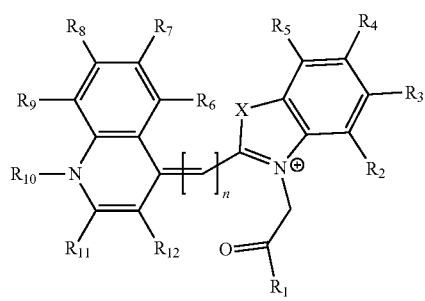

(II)

Wherein:

In selected embodiments, $R_1$ of compounds of Formula I or Formula II may be functionalized. For example, TO1-Acetate may be used as the basis for attaching a biotin tag for in vitro selection and subsequent complex purification. Embodiments have for example been tested and shown to work having biotinylated $R_1$ substituents, with PEG linkers, for TO1 (n=1) and TO3 (n=3), including biotin (with variable length PEG linkers), desthiobiotin (with variable length PEG linkers), and CY5$^{tm}$, wherein $R_1$ is, respectively:

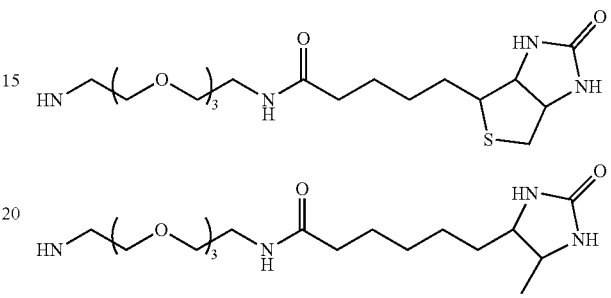

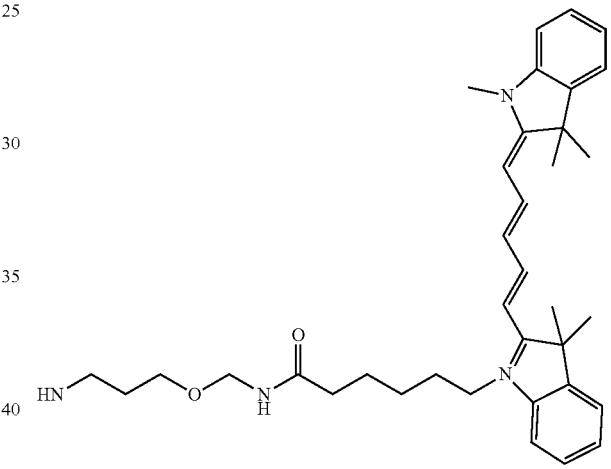

Advantageously, the following other specific compounds are encompassed by the invention:

| R Groups | |
|---|---|
| $R_1$ | Any substituent which allows the fluorophore compound to perform its intended function, eg: biotin, fluorescent dyes, NEB SNAP tags, with or without an amide bond in the linker. |
| $R_2$ through $R_5$ | H, F, Cl, Br, I, $CH_3$, linear polymers, extended heterocycles (i.e. built of adjacent pairs of groups). |
| $R_6$-$R_9$ | H, F, Cl, Br, I, $CH_3$, linear polymers, extended heterocycles (i.e. built of adjacent pairs of groups). |
| $R_{10}$ | H, F, Cl, Br, I, $CH_3$, linear polymers, extended heterocycles. |
| $R_{11}$ through $R_{12}$ | H, F, Cl, Br, I, $CH_3$, linear polymers, extended heterocycles (i.e. built of adjacent pairs of groups). |
| X atoms | O (YO3), S (TO1 & TO3), Se. |
| n (bridging groups) | 1 (TO1) or 3 (TO3), or 5. |

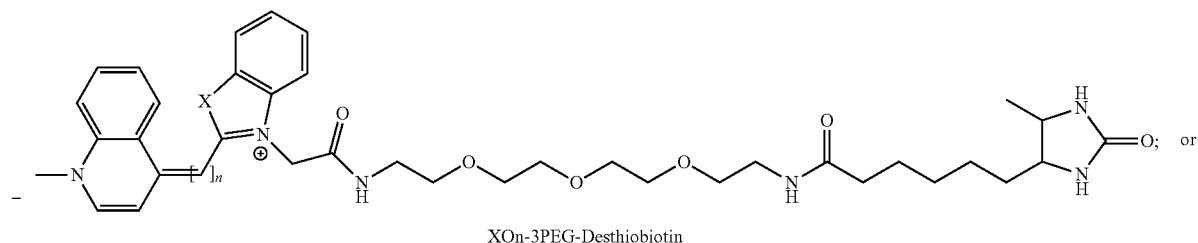
XOn-3PEG-Desthiobiotin
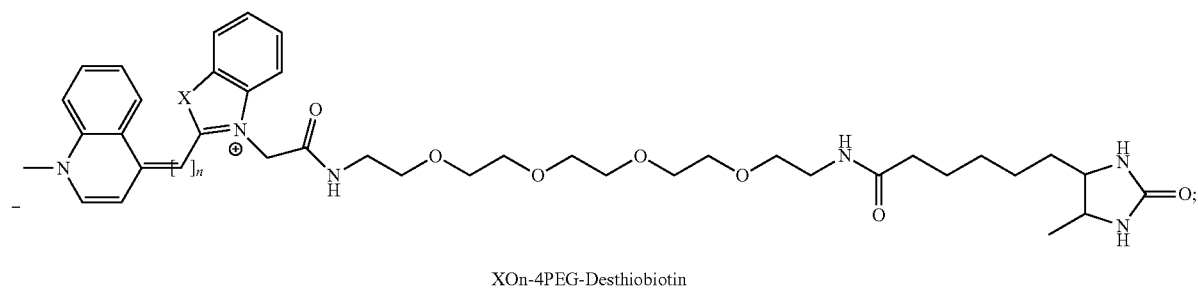
XOn-4PEG-Desthiobiotin
and in particular
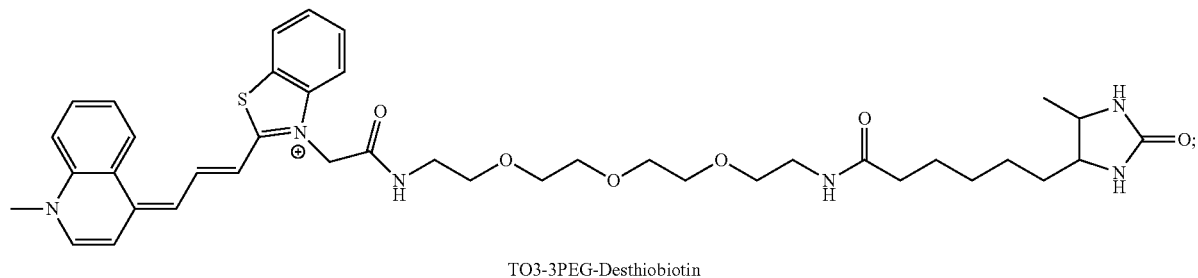
TO3-3PEG-Desthiobiotin
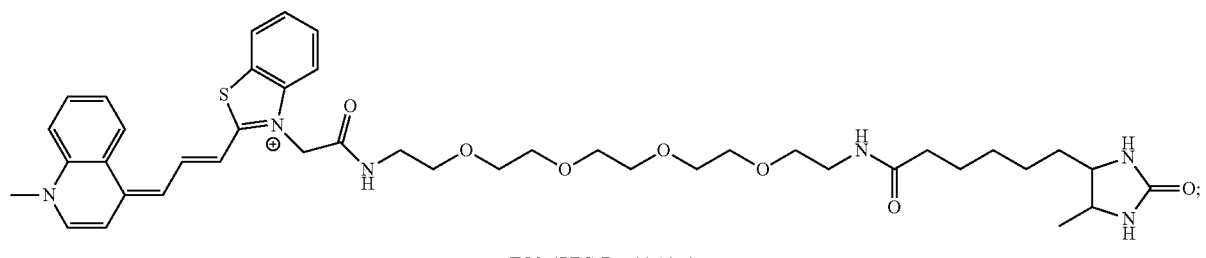
TO3-4PEG-Desthiobiotin
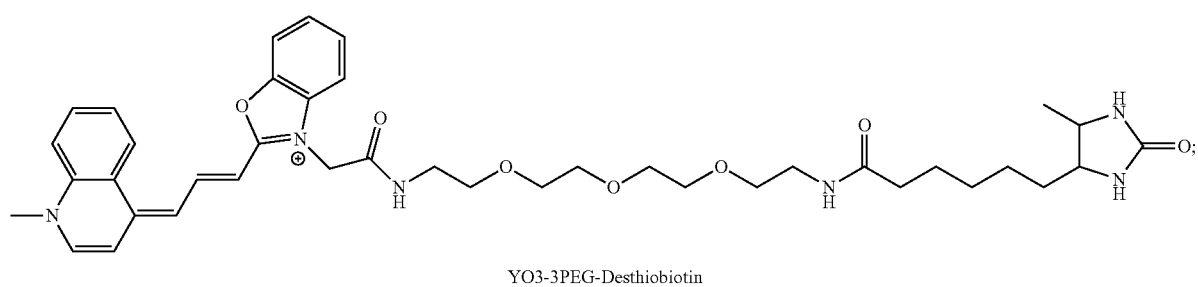
YO3-3PEG-Desthiobiotin -continued
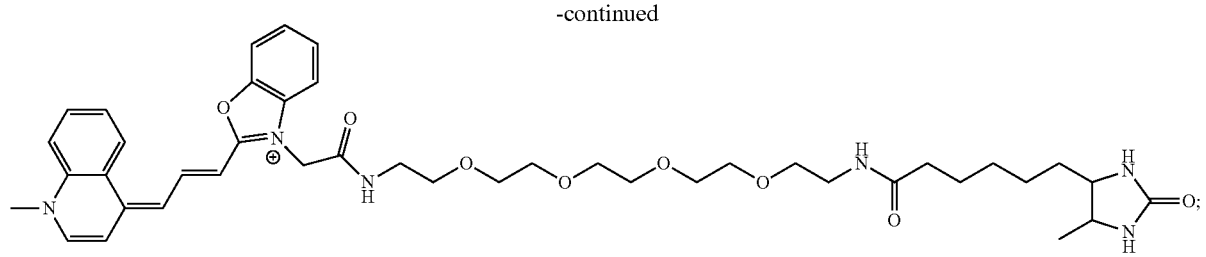
YO3-4PEG-Desthiobiotin
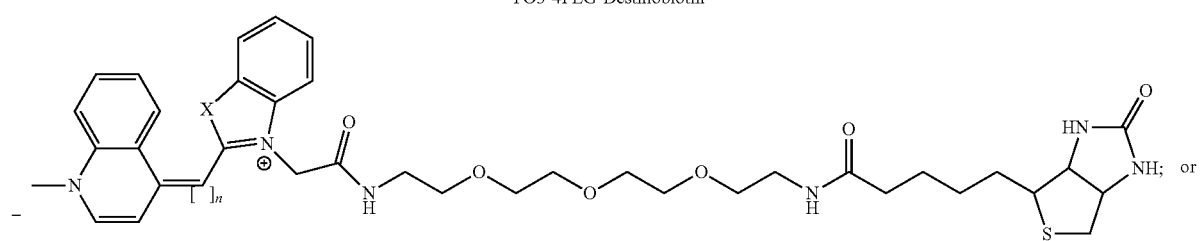
XOn-3PEG-Biotin
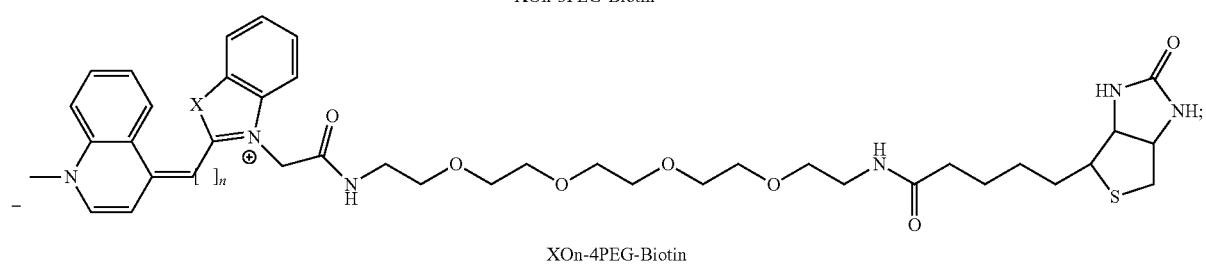
XOn-4PEG-Biotin
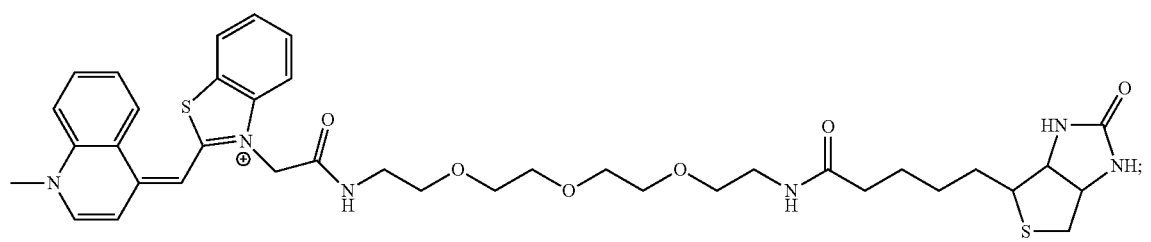
TO1-3PEG-Biotin
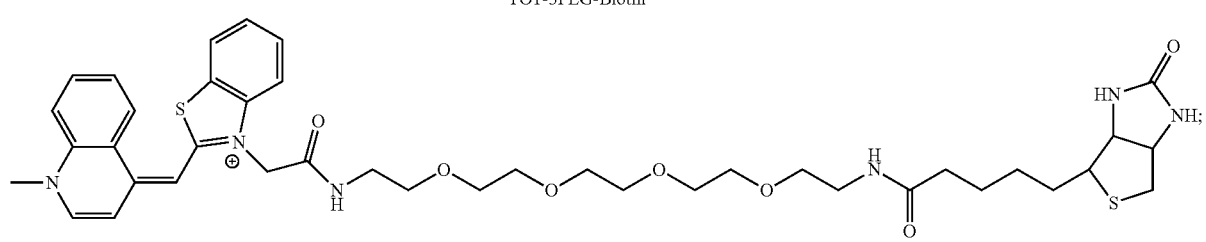
TO1-4PEG-Biotin
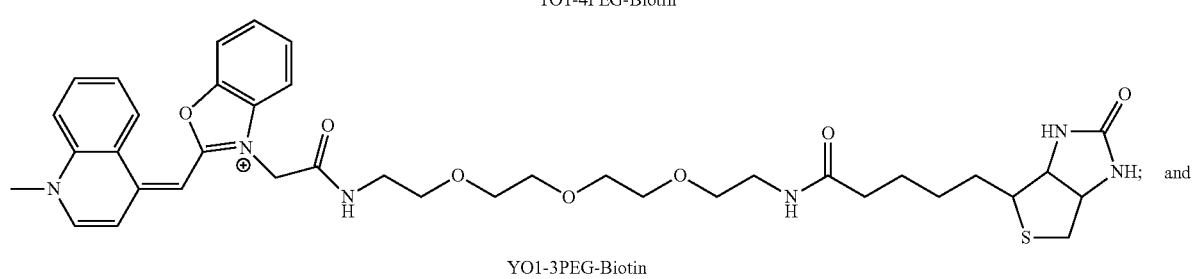
YO1-3PEG-Biotin

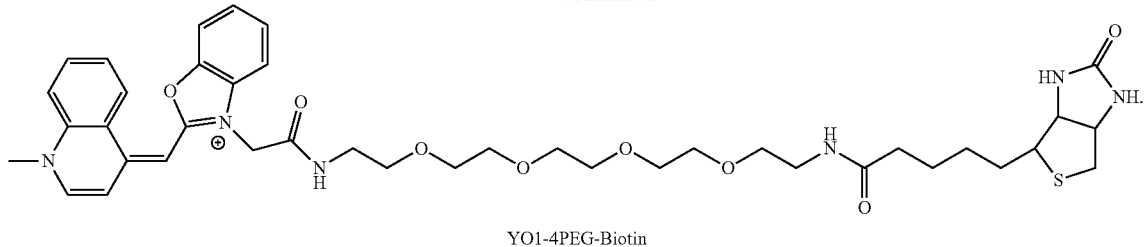

YO1-4PEG-Biotin

Unless explicitly stated otherwise, the terms "alkyl" and "heteroalkyl" each includes any reasonable combination of the following: (1) saturated alkyls as well as unsaturated alkyls (e.g. alkenyls and alkynyls); (2) linear or branched; (3) acyclic, cyclic (aromatic or nonaromatic) or multi-cyclic (fused rings, multiple non-fused rings or a combination thereof); and (4) unsubstituted or substituted. For example, an alkyl or heteroalkyl (i.e. "alkyl/heteroalkyl") may be saturated, branched and cyclic, or unsaturated, branched and cyclic, or linear and unsaturated, or any other reasonable combination according to the skill of the person of skill in the art. Where the size of the alkyl/heteroalkyl is specified as $X_1$-$X_z$, where z is any integer larger than 1 (e.g. 15, 18, 30, 100 or the like), it will be understood that the alkyl/heteroalkyl comprises at least 3 carbons and heteroatoms so as to form a ring. If unspecified, the size of the alkyl/heteroalkyl is what would be considered reasonable to the person of skill in the art. For example, but without limitation, if unspecified, the size of an alkyl may be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 89, 90, 91, 92, 93, 94, 95, 96, 97, 98, 99, 100 or more than 100 carbons in length, subject to the common general knowledge of the person of skill in the art. Further, but without limitation, if unspecified, the size of a heteroalkyl may be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 89, 90, 91, 92, 93, 94, 95, 96, 97, 98, 99, 100 or more than 100 carbons and heteroatoms in length, subject to the common general knowledge of the person of skill in the art.

For convenience, unless otherwise specified the term "alkyl" shall without limitation include "alkylenyl" unless the context of its use clearly excludes alkylenyls, and vice versa. For example, but without limitation, where $R^1$, $R^2$ and $R^3$ in $R^1$-$R^2$—$R^3$ are identified as alkyl groups, it will be understood that $R^2$ is an alkylenyl group and, similarly, $R^1$ and $R^3$ do not include alkylenyl groups.

As used herein, in the context of an alkyl/heteroalkyl group of a compound, the term "linear" may be used as it is normally understood to a person of skill in the art and generally refers to a chemical entity that comprises a skeleton or main chain that does not split off into more than one contiguous chain. Non-limiting examples of linear alkyls include methyl, ethyl, n-propyl, and n-butyl.

As used herein, the term "branched" may be used as it is normally understood to a person of skill in the art and generally refers to a chemical entity that comprises a skeleton or main chain that splits off into more than one contiguous chain. The portions of the skeleton or main chain that split off in more than one direction may be linear, cyclic or any combination thereof. Non-limiting examples of a branched alkyl group include tert-butyl and isopropyl.

As used herein, the term "saturated" when referring to a chemical entity may be used as it is normally understood to a person of skill in the art and generally refers to a chemical entity that comprises only single bonds. Non-limiting examples of a saturated $C_1$-$C_{15}$ alkyl group may include methyl, ethyl, n-propyl, i-propyl, sec-propyl, n-butyl, i-butyl, sec-butyl, t-butyl, n-pentyl, i-pentyl, sec-pentyl, t-pentyl, n-hexyl, i-hexyl, 1,2-dimethylpropyl, 2-ethylpropyl, 1-methyl-2-ethylpropyl, l-ethyl-2-methylpropyl, 1,1,2-trimethylpropyl, 1,1,2-triethylpropyl, 1,1-dimethylbutyl, 2,2-dimethylbutyl, 2-ethylbutyl, 1,3-dimethylbutyl, 2-methylpentyl, 3-methylpentyl, sec-hexyl, t-hexyl, n-heptyl, i-heptyl, sec-heptyl, t-heptyl, n-octyl, i-octyl, sec-octyl, t-octyl, n-nonyl, i-nonyl, sec-nonyl, t-nonyl, n-decyl, i-decyl, sec-decyl and t-decyl. Non-limiting examples of $C_2$-$C_{15}$ alkenyl group may include vinyl, allyl, isopropenyl, l-propene-2-yl, 1-butene-l-yl, 1-butene-2-yl, l-butene-3-yl, 2-butene-l-yl, 2-butene-2-yl, octenyl and decenyl. Non-limiting examples of $C_2$-$C_{15}$ alkynyl group may include ethynyl, propynyl, butynyl, pentynyl, hexynyl, heptynyl, octynyl, nonynyl and decynyl. Without limitation, the above-defined saturated $C_1$-$C_{15}$ alkyls, $C_2$-$C_{15}$ alkenyls and $C_2$-$C_{15}$ alkynyls are all encompassed within the term "$X_1$-$X_{15}$ alkyl", as used herein. Without limitation, the term "$X_1$-$X_{15}$ heteroalkyl" would encompass each of the above-defined saturated $C_1$-$C_{15}$ alkyls, $C_2$-$C_{15}$ alkenyls and $C_2$-$C_{15}$ alkynyls, where one or more of the carbon atoms is independently replaced with a heteroatom. The person of skill in the art would understand that various combinations of different heteroatoms may be used.

Unless explicitly stated otherwise, the terms "aryl" and "heteroaryl" each includes any reasonable combination of the following: (1) cyclic or multi-cyclic (fused rings, multiple non-fused rings or a combination thereof); and (2) aromatic (i.e. unsaturated rings) or nonaromatic (i.e. saturated rings); and (3) unsubstituted or substituted. Non-limiting examples of aryls or heteroaryls (i.e. "aryl/heteroaryl") include: phenyl, naphthyl, thienyl, indolyl, pyridyl and the like. If unspecified, the size of the aryl/heteroaryl is what would be considered reasonable to the person of skill in the art. For example, but without limitation, if unspecified, the size of an aryl may be 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 89, 90, 91, 92, 93, 94, 95, 96, 97, 98, 99, 100 or more than 100 carbons in length, subject to the common general knowledge of the person of skill in the art. Further, but without limitation, if unspecified, the size of a heteroaryl may be 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 89, 90, 91, 92, 93, 94, 95, 96, 97, 98, 99, 100 or more than 100 carbons and heteroatoms in length, subject to the common general knowledge of the person of skill in the art. It is noted that an aryl or heteroaryl may have all or only a portion of its skeleton or main chain bonded in such a way so as to form a 'loop', circle or ring of atoms bonded together. That is, the aryl/heteroaryl may comprise linear or branched chains of carbons/heteroatoms that are not part of a ring or loop.

As used herein, the term "substituted" is used as it would normally be understood to a person of skill in the art and generally refers to a compound or chemical entity that has one chemical group replaced with a different chemical group. Unless otherwise specified, a substituted alkyl may be an alkyl in which one or more hydrogen atom(s) may be/are replaced with one or more atom(s) that may be/are not hydrogen(s). For example, chloromethyl is a non-limiting example of a substituted alkyl, more particularly an example of a substituted methyl. Aminoethyl is another non-limiting example of a substituted alkyl, more particularly an example of a substituted ethyl. Unless otherwise specified, a substituted compound or group (e.g. alkyl, heteroalkyl, aryl, heteroaryl and the like) may be substituted with any chemical group reasonable to the person of skill in the art. For example, but without limitation, a hydrogen bonded to a carbon or heteroatom (e.g. N) may be substituted with halide (e.g. F, I, Br, Cl), amide, oxo, hydroxyl, thiol, phosphate, phosphonate, sulfate, $SO_2H$, $SO_3H$, alkyls, heteroalkyls, aryl, heteroaryl, ketones, carboxaldehyde, carboxylates, carboxamides, nitriles, monohalomethyl, dihalomethyl, trihalomethyl.

As used herein, the term "unsubstituted" is used as it would normally be understood to a person of skill in the art. Non-limiting examples of unsubstituted alkyls include methyl, ethyl, tert-butyl, and pentyl. The expression "optionally substituted" is used interchangeably with the expression "unsubstituted or substituted".

Although various embodiments of the invention are disclosed herein, many adaptations and modifications may be made within the scope of the invention in accordance with the common general knowledge of those skilled in this art. Such modifications include the substitution of known equivalents for any aspect of the invention in order to achieve the same result in substantially the same way. Numeric ranges are inclusive of the numbers defining the range, and inclusive of all numbers and fractions subsumed within the respective ranges. The word "comprising" is used herein as an open-ended term, substantially equivalent to the phrase "including, but not limited to", and the word "comprises" has a corresponding meaning. Terms such as "consisting essentially of" and "consists essentially of" allow for elements not explicitly recited, but exclude elements that are found in the prior art or that affect a basic or novel characteristic of the invention. As used herein, the singular forms "a", "an" and "the" include plural referents unless the context clearly dictates otherwise. Thus, for example, reference to "a thing" includes more than one such thing. Citation of references herein is not an admission that such references are prior art to the present invention. Any priority document(s) and all publications, including but not limited to patents and patent applications, cited in this specification are incorporated herein by reference as if each individual publication were specifically and individually indicated to be incorporated by reference herein and as though fully set forth herein. The invention includes all embodiments and variations substantially as hereinbefore described and with reference to the examples and drawings. Nothing herein is intended as a promise of any specific utility for all embodiments.

The term "about" or "approximately" as used herein when referring to a measurable value such as a parameter, an amount, a temporal duration, and the like, is meant to encompass variations of +/−20% or less, preferably +/−10% or less, more preferably +/−5% or less, and still more preferably +/−1% or less of and from the specified value, insofar such variations are appropriate to perform in the disclosed invention. It is to be understood that the value to which the modifier "about" or "approximately" refers is itself also specifically, and preferably, disclosed.

All references cited in the present specification are hereby incorporated by reference in their entirety. In particular, the teachings of all references herein specifically referred to are incorporated by reference, along with all documents cited in documents that are cited herein.

Standard reference works setting forth the general principles of recombinant DNA technology include Molecular Cloning: A Laboratory Manual, 2nd ed., vol. 1-3, ed. Sambrook et al., Cold Spring Harbor Laboratory Press, Cold Spring Harbor, N.Y., 1989; Current Protocols in Molecular Biology, ed. Ausubel et al., Greene Publishing and Wiley-Interscience, New York, 1992 (with periodic updates) ("Ausubel et al. 1992"); the series Methods in Enzymology (Academic Press, Inc.); Innis et al., PCR Protocols: A Guide to Methods and Applications, Academic Press: San Diego, 1990; PCR 2: A Practical Approach (M. J. MacPherson, B. D. Hames and G. R. Taylor eds. (1995); Harlow and Lane, eds. (1988) Antibodies, a Laboratory Manual; and Animal Cell Culture (R. I. Freshney, ed. (1987). General principles of microbiology are set forth, for example, in Davis, B. D. et al., Microbiology, 3rd edition, Harper & Row, publishers, Philadelphia, Pa. (1980).

Reference throughout this specification to "one embodiment" or "an embodiment" means that a particular feature, structure or characteristic described in connection with the embodiment is included in at least one embodiment of the present invention. Thus, appearances of the phrases "in one embodiment" or "in an embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention, and form different embodiments, as would be understood by those in the art. For example, in the appended claims, any of the claimed embodiments can be used in any combination.

In this description of the invention, reference is made to the accompanying drawings that form a part hereof, and in which are shown by way of illustration only of specific embodiments in which the invention may be practiced. It is to be understood that other embodiments may be utilized and structural or logical changes may be made without departing from the scope of the present invention. The description, therefore, is not to be taken in a limiting sense, and the scope of the present invention is defined by the appended claims.

It is an object of the invention to not encompass within the invention any previously known product, process of making the product, or method of using the product such that Applicants reserve the right and hereby disclose a disclaimer of any previously known product, process, or method. It is further noted that the invention does not encompass any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product.

Preferred statements (features) and embodiments may be combined with any other features or embodiments unless clearly indicated to the contrary. In particular, any feature indicated as being preferred or advantageous may be combined with any other feature or features or statements indicated as being preferred or advantageous.

PROTOCOL EXAMPLES

High Throughput Screening

Digital droplet PCR: DNA libraries were diluted in 200 µg/mL yeast total RNA solution (Ambion) down to ~8 template DNA molecules per picoliter to have $\lambda=0.2$, or ~40 templates DNA molecules per picoliter. 1 µL of this dilution was then introduced in 100 µL of a PCR mixture containing 0.2 µM of Forward primer (5'-CTT AAT TAC GAC TCA CTA TAG GAA CCC GCA AGC CAT C (SEQ ID NO: 6900), 0.2 µM of Reverse primer (5'-CAG AAT CTC ACA CAG CC(SEQ ID NO: 6901)), 0.2 mM of each dNTP, 0.67 mg/mL Dextran-Texas Red 70 kDa (Molecular Probes), 0.1% Pluronic F68, Phire II DNA polymerase (Thermo-Scientific) and the corresponding buffer according to recommended concentrations. The mixture was loaded in a length of PTFE tubing and infused into a droplet generator microfluidic device where it was dispersed into 2.5 pL droplets (production rate of ~12,000 droplets/second) carried by HFE 7500 fluorinated oil (3M) supplemented with 3% of a fluorosurfactant. Droplet production frequency was monitored and used to determine droplet volume by adjusting pumps flow rates (MFCS, Fluigent). Emulsions were collected in 0.2 µL tubes, and subjected to an initial denaturation step of 2 min at 95° C. followed by 30 PCR cycles of: 30 sec at 95° C., 30 sec at 55° C., 1 min 30 at 72° C.

Droplet fusion: PCR droplets were then injected into a fusion device at a rate of ~1,500 droplets/second, spaced by a stream of HFE 7500 fluorinated oil supplemented with 2% fluorosurfactant. Each PCR droplet was synchronized with a 16 µL in vitro transcription (IVT) droplet containing 2.2 mM of each NTP (Larova), 24 mM $MgCl_2$, 44 mM Tris-HCl pH 8.0, 50 mM KCl, 5 mM DTT, 1 mM Spermidine, 35 µg/mL of Dextran-Texas Red 70 kDa (Molecular Probes), 0.1% Pluronic F68, 20 µg/mL T7 RNA polymerase (purified in the laboratory), 100 nM TO1-Biotin (Dolgosheina et al., 2014), 1 µg inorganic pyrophosphatase (Roche) supplemented with the desired concentration of NMM. For the screenings performed in the presence of TO3-Biotin (Dolgosheina et al., 2014), the T7 RNA polymerase (New England Biolabs) concentration was reduced to 70 U per reaction. The IVT mixture was loaded in a length of PTFE tubing that was kept on ice during all the experiment. IVT droplets were produced using a stream of HFE 7500 fluorinated oil supplemented with 2% (w/w) of fluorinated surfactant. Flow-rates (MFCS, Fluigent) were adjusted to generate 16 pL IVT droplets and maximize the synchronization of one PCR droplet with one IVT droplet. Pairs of droplets were then fused with an AC field (350 V at 30 kHz) and the resulting emulsion collected off-chip and incubated for 120 min (high concentration of T7 RNA polymerase, NMM screenings) or 30 min (low concentration of T7 RNA polymerase, TO3-Biotin screenings) at 37° C. Droplet analysis and sorting: The emulsion was finally re-injected into an analysis and sorting microfluidic device mounted on a Thermo plate (Tokai Hit) holding the temperature at 45° C. as previously described[3]. Droplets were re-injected at a frequency of ~200 droplets/second, spaced with a stream of surfactant-free HFE 7500 fluorinated oil. The green fluorescence (TO1-Biotin in complex with the aptamer) of each droplet was analysed and the droplets having the highest green fluorescence were sorted. The gated droplets were deflected into collecting channel by applying a 1 ms AC field (1200 V, 30 kHz) and collected into a 1.5 mL tube. Collected droplets were recovered by flushing 200 µL of HFE 7500 fluorinated oil (3M) through the tubing. 100 µL of 1H, 1H, 2H, 2H-perfluoro-1-octanol (Sigma-Aldrich) and 200 µL of 200 µg/mL yeast total RNA solution (Ambion) were then added, the droplets were broken by vortexing the mixture and DNA-containing aqueous phase was recovered.

Quantification of RNA Produced in Droplets

A PCR mixture supplemented with DNA coding for RNA Mango ($\lambda=10$, ensuring that all the droplets were occupied) was emulsified in 2.5 pL droplets and the DNA amplified as above. The droplets were paired and fused with droplets of in vitro transcription mixture containing either a low (70 U of enzyme from New England Biolabs) or a high (20 µg/mL of enzyme purified in the lab) concentration of T7 RNA polymerase and the resulting emulsions were incubated for respectively 30 min or 120 min at 37° C. After incubation, the RNA-containing phase was recovered using 1H, 1H, 2H, 2H-perfluoro-1-octanol (Sigma-Aldrich) and the transcription was stopped by a phenol extraction followed by an ethanol precipitation in the presence of 300 mM sodium acetate pH 5.5 (Sigma-Aldrich). After centrifugation and a wash in 70% ethanol, the pellets were re-suspended in water. 10 U of Baseline-Zero™ DNase (Epicentre) and the corresponding buffer were added and a second incubation of 60 min at 37° C. was performed. The DNase was removed by phenol extraction and RNA recovered by ethanol precipitation.

Recovered RNAs, were reverse transcribed for 60 min at 55° C., followed by 5 min at 95° C., in a mixture containing 10 pmol of Reverse primer, 0.5 mM of each dNTPs RT Maxima (Thermo-Scientific) and the corresponding buffer according to recommended concentrations. The cDNA was amplified using SsoFast™ Evagreen supermix (Bio-Rad) supplemented with 0.2 µM of each primer (Forward and Reverse) using a CFX96 Touch™ Real TimePCR Detection System (Bio-Rad). Finally the cDNA was quantified using the calibration curve obtained with reactions performed with purified RNAs.

Enrichment Measurement

The pool molecules contained in 2 µL recovered from the sorted fractions were introduced into 100 µL of PCR mixture containing 0.1 µM of each primer (Fwd and Rev), 0.2 mM of each dNTP, 0.05 U/µL of DreamTaq™ and its corresponding buffer (Fermentas). The mixture was then subjected to an initial denaturation step of 30 sec at 95° C., followed by 20 cycles of: 5 sec at 95° C. and 30 sec at 60° C. 20 µL of PCR products were then in vitro transcribed in 250 µL of mixture containing 2 mM of each NTP, 25 mM MgCl$_2$, 40 mM Tris-HCl pH 8.0, 5 mM DTT, 1 mM Spermidine and 70 µg/mL T7 RNA polymerase. After 4 hours of incubation at 37° C., 10 U of Baseline-Zero™ DNase (Epicentre) and the corresponding buffer were added and the mixture was incubated for 60 min at 37° C. RNAs were recovered by phenol extraction followed by an ethanol precipitation in the presence of 300 mM sodium acetate pH 5.5 (Sigma-Aldrich). After centrifugation and a wash in 70% ethanol, the pellets were dissolved in denaturing loading buffer (0.05% bromophenol blue, 0.05% xylene cyanol, 20% glycerol, 1× TBE, 8 M urea) and the solution loaded onto a 12% denaturing 8 M urea acrylamide/bisacrylamide gel. The piece of gel containing RNA was identified by UV shadowing, sliced from the gel and transferred into a dialyze tube (MWCO=3 500, Spectrum Lab) filled with TBE. RNA was electro-eluted by placing the montage in TBE for 60 min at 100 V. Eluted RNA were filtered in centrifuge tube (porosity 0.45 µm, VWR) and ethanol precipitated in the presence of 300 mM sodium acetate pH 5.5. After centrifugation and a wash in 70% ethanol, the pellets were dissolved in DEPC-Treated water and quantified with Nanodrop (Thermo Scientific).

In the case of NMM screenings, 2 µM of RNA were incubated with 100 nM of TO1-Biotin in 40 mM Tris-HCl pH 8.0, 50 mM KCl, and 22 mM MgCl$_2$. Eventually, NMM (3 µM) was added and TO1-Biotin fluorescence (ex. 492 nm/em. 516 nm) measured. In the case of TO3-Biotin screenings, 300 nM of RNA and 100 nM of TO1-Biotin were used with or without 1.6 µM of TO3-Biotin. Both green (ex. 492 nm/em. 516 nm) and red (ex. 635 nm/em. 665 nm) fluorescence were measured.

TA-Cloning, Sequencing and Colony Screening

Genes contained in the libraries were diluted in a PCR mixture as a immediately above and thermocycled 25 times using a final extension step of 10 min at 72° C. PCR products were inserted in pTZ57R/T vector following manufacturer's instruction (InsTAclone PCR cloning Kit, Thermo-Scientific). Ligation products were recovered by phenol/chloroform extraction and ~100 ng of DNA used to transform Electro-10 blue bacteria (Agilent) placed in a 2 mm electroporation (MicroPulser, Bio-Rad). After an hour of recovery at 37° C. under agitation, bacteria were plated on Luria broth (LB)-Ampicillin agar plate and incubated overnight at 37° C. The colonies were picked, used to inoculate liquid LB and grown at 37° C. until saturation. Plasmids DNA were extracted using "GeneJet Plasmid Miniprep kit" (Thermo-Scientific), and sequences determined by Sanger approach (GATC Biotech).

Single colonies were introduced in 10 µL of a PCR mixture identical to that used for TA-cloning and the DNA amplified as above. 2 µL of PCR product added to 18 µL of in vitro transcription mixture containing 2 mM of each NTP, 25 mM MgCl$_2$, 40 mM Tris-HCl pH 8.0, 50 mM KCl, 5 mM DTT, 1 mM Spermidine, 70 µg/mL T7 RNA polymerase and 100 nM TO1-Biotin. The mix was then split in two and one aliquot was supplemented with 3 µM of NMM. The reaction was incubated in a real-time thermocycler (Mx 3005P, Agilent) for 2 hours at 37° C. and the green fluorescence (ex. 492 nm/em. 516 nm) measured every minute.

DMS Probing of Mangos

DMS (Denaturing): Protocol is adapted from Lorsch and Szostak, 1994[13]. 50 nM RNA was 3' end labelled with $^{32}$pCp and gel purified. The resulting RNA was incubated in 50 mM HEPES pH 7.5 (volume 50 µL) at room temperature for 30 min. After incubation, 10 µg carrier RNA was added. The sample was then heated to 90° C. for 3 min before the addition of 0.5 µL of 25% DMS (diluted in ethanol) and heated to 80° C. for 1 min. 150 µL ice cold ethanol+5 µL 3 M NaCl was then immediately added and moved to −20° C. for 30 min. DMS modified RNA was pelleted by centrifuge at 16,300 RCF at 4° C. for 20 min.

DMS (Native): 50 nM 3' end labeled RNA was incubated in 50 mM HEPES pH 7.5, 1 mM MgCl$_2$, 140 mM either KCl or NaCl, with or without 500 nM TO1-Biotin (final volume 50 µL) at room temperature for 30 min. After incubation, 10 µg carrier RNA was added. The sample was then incubated at room temperature for 15 min after the addition of 0.5 µL of 100% DMS. 150 µL ice cold ethanol+5 µL 3 M NaCl was then immediately added and pelleted as for the denaturing DMS protocol.

Reduction: Pellets were resuspended in 10 µL 1 M Tris buffer pH 8 and 10 µL of freshly prepared 0.2 M sodium borohydride was added. Reaction was carried out on ice and in the dark for 30 min. Reactions were stopped by ethanol precipitation as above.

Aniline Cleavage: To the resulting pellet, 20 µL (1 part Aniline, 7 parts ddH$_2$O, 3 parts glacial acetic acid) were added and incubated at 60° C. for 15 min in the dark. Samples were flash frozen by placing tubes in liquid nitrogen and lyophilized by speed vacuum centrifuge. Once dry, 20 µL ddH$_2$O was added, the sample refrozen and lyophilized once again. The pellet was resuspended in a 50% formamide denaturing solution before being loading on a 15% polyacrylamide gel (19:1 acrylamide:bis).

T1 RNase Ladder and Alkaline Hydrolysis Ladder: 200 pmol 3' end labeled RNA was incubated in 20 mM sodium citrate, 6.3 M urea, and 1 U/µL T1 RNase (Thermo Scientific) at 50° C. for 10 min. Samples was flash frozen in liquid nitrogen for 5 min, heat denatured in denaturing solution at 95° C. for 5 min prior to gel loading. Hydrolysis ladders were generated by incubating in 50 mM NaHCO$_3$ at 90° C. for 20 min and neutralizing using 0.17 M Tris-HCl.

Screening for Minimal Functional Mango Motifs

To identify the minimal functional motif of each Mango, truncated constructs were designed as shown in FIG. 9. DNA constructs (IDT) were transcribed by run-off transcription using T7 RNA polymerase. RNA was gel purified on 10% polyacrylamide gels. RNA concentrations were determined by NanoDrop readings at A$_{260}$, where extinction coefficients were estimated based on average 11,000 M$^{-1}$cm$^{-1}$ per base.

Affinity Measurements of Mango Variants

Fluorescence data was gathered using a Varian Cary Eclipse Spectrophotometer unless otherwise stated. Fluorescent titrations in the in vivo mimicking buffer (WB: 140 mM KCl, 1 mM MgCl$_2$, 10 mM NaH$_2$PO$_4$ pH 7.2, 0.05% Tween-20) were performed to determine binding affinities. Fluorescence was measured at the maximum excitation and emission wavelengths of each complex (FIG. 13). Curves were fitted using least squares (Kaleidagraph 4.5) using the following equation for TO1-Biotin:

$$F([RNA])=F_{max}[(K_D+[RNA]+[Fluorophore])/2-\sqrt{(([RNA]-[Fluorophore])2+K_D(K_D+2[RNA]+2[Fluorophore]))]/2}+F_{unbound} \quad (Eq. 1)$$

Where F([RNA]) is the fluorescence as a function of RNA concentration [RNA], $F_{max}$ is the maximal fluorescence of the bound complex and $F_{unbound}$ the fluorescence of the unbound fluorophore. When the fluorescence of $F_{unbound}$ was undetectable, it was set to zero.

Or to the following equation for TO3-Biotin and NMM experiments:

$$F([RNA])=F_{max}[RNA]/(K_D+[RNA])+F_{unbound} \quad (Eq. 2)$$

$F_{max}$ was determined using Eq. 1 or Eq. 2 as appropriate.

Temperature Dependent Fluorescence and UV Melting Curves

Temperature dependence measurements were started at 90° C. decreasing at a rate of 1° C./min until 20° C., then returned at 1° C./min until 90° C. was reached. Fluorescence measurements were obtained at the maximum excitation/emission of the fluorescent complex used and were measured in WB buffer using 1 µM RNA either with or without 5 µM TO1-Biotin. Temperature dependence of fluorescence and absorbance were measured using a Varian Cary Eclipse Fluorescence Spectrophotometer at excitation and emission peaks and a Varian Cary 100 Bio UV-visible spectrophotometer monitoring at 260 nm.

Circular Dichroism

Circular dichroism spectra were obtained on an Applied Photophysics Chirascan Circular Dichroism Spectrometer using 5 µM RNA, 140 mM monovalent salts and 7 µM TO1-Biotin. Spectra were scanned in 1 nm steps with a bandwidth of 1 nm. Data shown is the average of three repeats. Samples were measured using a 1 mm pathlength quartz cuvette (Starna Cells Inc.).

Formaldehyde Resistance Assay

RNA Mango aptamers were incubated with TO1-Biotin in WB buffer for at least one hour until equilibrium fluorescence was reached. Formaldehyde was then added such that final concentrations after dilution were 50 nM RNA, 100 nM TO1-Biotin and 0, 2, 4, or 8% formaldehyde. Fluorescence was measured as a kinetic run at a rate of 2 readings per minute using a Varian Cary Eclipse Fluorescence Spectrophotometer, ex/em=510±2.5/535±5 nm.

Cell Culture and Maintenance

HEK293T cells were grown in Dulbecco Modified Eagle's Medium containing 10% Fetal Bovine Serum, 2 mM D-Glucose, 2 mM L-Glutamine, 1 mM Sodium Pyruvate and 100 U/ml Penicillin/Streptomycin (Thermo Fisher) and maintained at 37° C. with 5% $CO_2$ in a humidified incubator. Cells used for imaging were cultured in Ibidi glass bottomed 8-well chamber slides (Ibidi GmbH).

5S-Mango RNA Synthesis and Purification

DNA encoding the F30 folding scaffold was modified to incorporate the Mango RNA sequences and ordered from (Intergrated DNA Technologies). The DNA was amplified by PCR to incorporate 5' SalI and 3' XbaI restriction sites. PCR products were digested using Fast Digest enzymes (Thermo Fisher) and ligated into SalI/XbaI linearized and Shrimp Alkaline Phosphotase (NEB) treated pAV5S-F30-2xdBroccoli (Addgene plasmid 66845, a gift from Dr S. Jaffrey). DNA encoding the full 5S-F30-Mango sequence was PCR amplified and a 5' T7 RNA polymerase promoter introduced. DNA was transcribed in vitro with T7 RNA polymerase (NEB) at 37° C. for 16 h in 40 mM Tris-HCl, 30 mM $MgCl_2$, 2 mM spermidine, 1 mM dithiothreitol, 5 mM rNTPs, 1 U/µl E. coli inorganic pyrophosphatase, 4 U/µl T7 RNA polymerase (pH 7.9). RNA was purified from an 8 M urea denaturing polyacrylamide and bis to acrylamide ratios here XX gel followed by elution in RNA elution buffer (40 mM Tris-HCl pH 8.0, 0.5 M sodium acetate, 0.1 mM EDTA) and ethanol precipitation. Fluorescence measurements were taken for each of the RNA constructs using a Varian Cary Eclipse Fluorescence Spectrophotometer (Agilent) containing 40 nM TO1-Biotin, 200 nM RNA, 10 mM Sodium Phosphate, 100 mM KCl and 1 mM $MgCl_2$ at pH 7.2. Similar measurements were also taken with a limiting amount of RNA (40 nM) in an excess of TO1-Biotin (200 nM) and the results showed a similar trend.

5S-Mango RNA Synthesis and Transfection

RNA was transfected directly into 8-well chamber slides using the Lipofectamine-based CRISPRMAX reagent following the manufacturers guidelines (Invitrogen). Initially 125 nM RNA containing 10 mM Sodium Phosphate buffer (pH 7.2), 100 mM KCl and 1 mM $MgCl_2$ was incubated at room temperature followed by a 1:1 dilution in OptiMEM prior to transfection. The RNA transfected was incubated at 37° C. for 1 hour in complete growth medium.

Cell Fixation and Immunostaining

Cells were fixed in PBS containing 4% paraformaldehyde for 10 min on ice (Thermo Fisher) followed by permeabilization in 0.2% Triton X-100 for 10 min at room temperature. Cells were first blocked (2% BSA in PBS) for 30 min followed by primary antibody (1:50-1:500 dilutions) incubation for 120 min in blocking solution.

Primary antibodies used here were: Anti-Ribosomal Protein S6 (MAB5436, R&D Systems), Anti-ATP5B (ab14730, Abcam), Anti-GW182 (ab7052, Abcam), Anti-EEA-1 (ab70521, Abcam), Anti-LSm3 (NBP2-14206, Novus Biologicals), Anti-TIAR (sc-398372, Santa Cruz). Secondary antibodies used were Donkey Anti-mouse and Donkey Anti-Rabbit Alexa Fluor 680 (Molecular Probes). Primary antibodies were washed three times for 20 min each in blocking solution followed by incubation with secondary antibody at 1:500 dilution for 60 min, which was subsequently washed as above. After immunostaining the cells were washed three times for 5 min each with PKM buffer (10 mM Sodium Phosphate, 100 mM KCl and 1 mM $MgCl_2$) followed by a 10 min incubation in 200 nM TO1-Biotin diluted in PKM buffer before replacing with imaging media (10 mM Sodium Phosphate, 100 mM KCl and 1 mM $MgCl_2$ 1 µg/ml Hoechst 33258).

Live-Cell Imaging and Fluorescence Microscopy

To visualize the nuclear boundary in live cells, a plasmid expressing a fluorescently tagged histone protein (EBFP2-H2B-6, Addgene plasmid 55243) was transfected using FuGene 6 (Promega) 24 h prior to RNA transfection. RNA was transfected directly into 8-well chamber slides (Ibidi GmbH) as described above, with an additional pre-incubation step with 250 nM of TO1-Biotin prior to the addition of the CRISPRMAX transfection reagent. Following incubation of the RNA transfection, the cells were washed once with PBS and replaced with live-cell imaging media (Fluorobrite DMEM supplemented with 20 mM HEPES, Invitrogen). Live and fixed cell images were taken using a Zeiss Elyra wide-field microscope by exciting at 405 nm (Blue), 488 nm (Green) and 642 nm (Far-Red) and detecting at 420-480 nm, 495-550 nm and >650 nm, respectively. Live cells were maintained at 37° C. with 5% $CO_2$ in a stage top incubator (Tokai Hit). Images were processed using FIJI and spot detection analysis was performed on each maximum projection by the spot detector plugin in the ICY image analysis software, which detects significant foci with a pixel area 3×3 pixels.

REFERENCES

1. Nicoludis, J. M. et al. Optimized End-Stacking Provides Specificity of N-Methyl Mesoporphyrin IX for Human Telomeric G-Quadruplex DNA. J. Am. Chem. Soc. 134, 20446-20456 (2012).
2. Dolgosheina, E. V. et al. RNA Mango Aptamer-Fluorophore: A Bright, High-Affinity Complex for RNA Labeling and Tracking. ACS Chem. Biol. 9, 2412-2420 (2014).
3. Autour, A., Westhof, E. & Ryckelynck, M. iSpinach: a fluorogenic RNA aptamer optimized for in vitro applications. Nucleic Acids Res. 44, 2491-2500 (2016).

4. Warner, K. D. et al. Structural basis for activity of highly efficient RNA mimics of green fluorescent protein. Nat. Struct. Mol. Biol. 21, 658-663 (2014).
5. Huang, H. et al. A G-quadruplex—containing RNA activates fluorescence in a GFP-like fluorophore. Nat. Chem. Biol. 10, 686-691 (2014).
6. Shaner, N. C., Steinbach, P. A. & Tsien, R. Y. A guide to choosing fluorescent proteins. Nat. Methods 2, 905-909 (2005).
7. Jeng, S. C. Y., Chan, H. H. Y., Booy, E. P., McKenna, S. A. & Unrau, P. J. Fluorophore ligand binding and complex stabilization of the RNA Mango and RNA Spinach aptamers. RNA (2016). doi:10.1261/rna.056226.116
8. Paige, J. S., Wu, K. Y. & Jaffrey, S. R. RNA Mimics of Green Fluorescent Protein. Science 333, 642-646 (2011).
9. Filonov, G. S., Kam, C. W., Song, W. & Jaffrey, S. R. In-Gel Imaging of RNA Processing Using Broccoli Reveals Optimal Aptamer Expression Strategies. Chem. Biol. 22, 649-660 (2015).
10. Karunatilaka, K. S. & Rueda, D. Post-transcriptional modifications modulate conformational dynamics in human U2-U6 snRNA complex. RNA 20, 16-23 (2014).
11. Smirnov, A., Entelis, N., Martin, R. P. & Tarassov, I. Biological significance of 5S rRNA import into human mitochondria: role of ribosomal protein MRP-L18. Genes Dev. 25, 1289-1305 (2011).
12. Ryckelynck, M. et al. Using droplet-based microfluidics to improve the catalytic properties of RNA under multiple-turnover conditions. RNA 21, 458-469 (2015).
13. Lorsch, J. R. & Szostak, J. W. In vitro selection of RNA aptamers specific for cyanocobalamin. Biochemistry (Mosc.) 33, 973-982 (1994).

EXAMPLES

Example 1: Crystal Structures of the Mango-II RNA Aptamer Reveal Heterogeneous Fluorophore Binding and Guide Engineering of Variants with Improved Selectivity and Brightness Several aptamers that induce fluorescence of their cognate small molecules by >1000-fold, and that can be used in vivo as RNA analogues of fluorescent proteins have been described.1-3 Among these, RNA Mango is noteworthy because of its small size (<30 nucleotides) and its high affinity for the thiazole orange-derived fluorophore, TO1-Biotin (Kd=3.1 nM). Moreover, its complex with the related fluorophore TO3-Biotin (Kd=8 nM) is one of the most red-shifted fluorogenic tags described to date, having an emission maximum of longer wavelength than the fluorescent protein mPlum.4 The Co-crystal structure of RNA Mango revealed a three-tiered G-quadruplex. TO1-Biotin binds on one of its flat faces, with each of its three heterocycles, benzothiazole (BzT), mehtylquinoline (MQ) and biotin sequestered under an unpaired nucleotide.5,6 Mango-II was recently obtained by subjecting the final pool of the RNA Mango selection to compartmentalization coupled to fluorescence sorting.7 Compared to the original aptamer (hereafter Mango-I), the new RNA is brighter (11,000 M-1 cm-1 vs. 17,000 M-1 cm-1 for Mango-I and Mango-II, respectively), and binds to both TO1-Biotin and TO3-Biotin (FIG. 35A) with higher affinity (Kd=1.1±0.3 nM and 1.4±0.3 nM, respectively). To elucidate the structural basis for the enhanced properties of Mango-II, and as a starting point for structure-guided engineering, we have now determined its co-crystal structures in complex with TO1-Biotin (FIG. 35B,C) and TO3-Biotin (FIG. 36) at 2.9 Å and 3.0 Å resolution, respectively (Table 6).

TABLE 6

Summary of crystallographic statistics

|  | Mango-II-TO1 | Mango-II-TO3 |
|---|---|---|
| Data collection |  |  |
| Space group | $C222_1$ | $C222_1$ |
| Cell dimensions |  |  |
| a, b, c (Å) | 36.83, 182.41, 107.49 | 37.10, 181.76, 108.290 |
| α, β, γ (°) | 90, 90, 90 | 90, 90, 90 |
| Resolution (Å) | 107.49-2.57 (2.68-2.57)$^a$ | 46.52-2.99 (3.2-2.99)$^a$ |
| $R_{merge}$ | 0.058 (>1) | 0.098 (0.93) |
| <I>/<σ(I)> | 18.6 (0.9) | 16.4 (0.5) |
| Completeness (%) | 98.8 (90.0) | 99.8 (99.6) |
| Redundancy | 8.8 (7.9) | 10.5 (4.1) |
| Refinement |  |  |
| Resolution (Å) | 91.21-2.90 (2.99-2.90) | 46.52-3.00 (3.19-3.00) |
| No. reflections | 15464 (1257) | 7735 (1268) |
| $R_{work}/R_{free}$ | 18.58/23.06 | 18.99/25.51 |
| No. atoms | 2453 | 2339 |
| RNA | 2283 | 2283 |
| TO1-Biotin | 162 | 48 |
| Ions | 8 | 8 |
| Water | 0 | 0 |
| B-factors (Å$^2$) | 75.32 | 57.38 |
| RNA | 75.29 | 57.53 |
| TO1-Biotin | 75.95 | 51.52 |
| Ions | 62.0 | 42.42 |
| Water | N.A. | N.A. |
| R.m.s deviations |  |  |
| Bond lengths (Å) | 0.007 | 0.006 |
| Bond angles (°) | 1.437 | 1.200 |

$^a$Values in parentheses are for highest-resolution shell.
One crystal was used for each data set.

Figure 37:
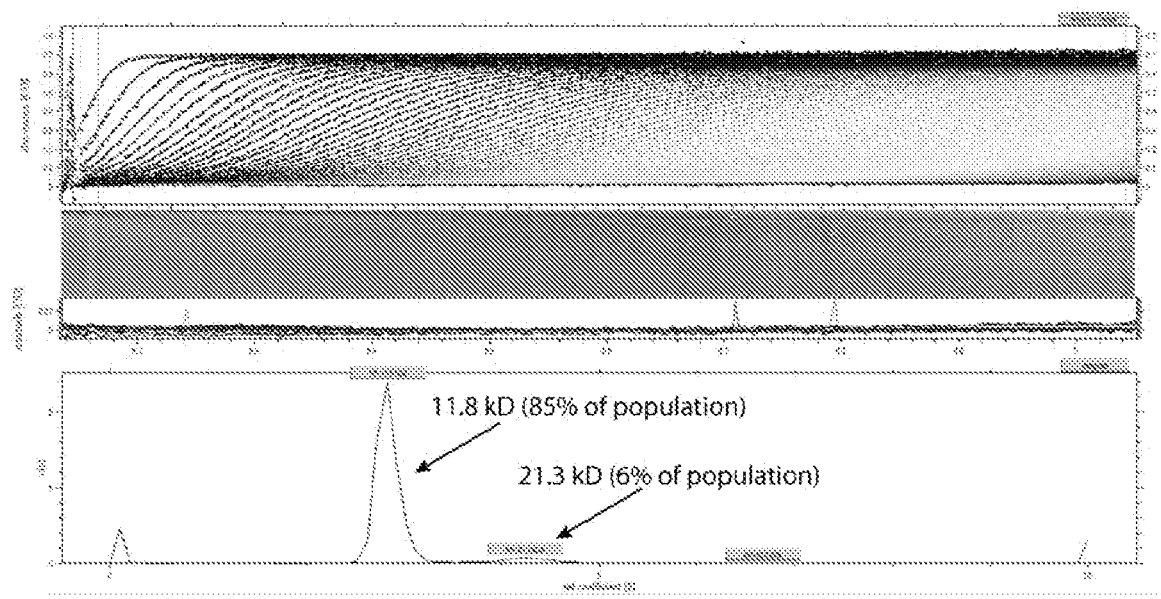

The two complexes crystallized in similar unit cells with three crystallographically independent RNAs (chains A, B, C) in the asymmetric unit (A.U.). Overall, the three RNAs in each structure are very similar (rmsd ~0.7 Å for all non-hydrogen RNA atoms), and so are the RNAs in complex with the two different fluorophores (rmsd ~0.2 Å between the best-ordered chains in each structure; the coordinate precisions of the two structures are 0.42 Å and 0.40 Å, respectively). The folds of Mango-I and Mango-II are overall similar, and this similarity extends to crystal packing, in which adjacent aptamers stack pairwise through their fluorophore-distal quadruplex faces. Nonetheless, and as in the case of Mango-II, analytical ultracentrifugation indicates the aptamer RNA is monomeric in solution (FIG. 37).

Mango-II has an almost identical melting profile in both the presence and absence of TO1-Biotin and is more thermostable than Mango-I.7 In addition, Mango-II is remarkably formaldehyde resistant; Mango-II reacted with formaldehyde, can still bind and induce fluorescence of TO1-Biotin. Together, these data suggest that the Mango-II aptamer has a pre-organized binding pocket.

Three structural differences between Mango-I and Mango-II are consistent with a higher stability of the latter RNA and its improved fluorophore affinity. First, each guanine in the T3 G-quartet is isolated from the T2 G-quartet by one of four adenine containing propeller loops (FIG. 38B). This approximate four-fold rotational symmetry is lacking in Mango-I where one T3 guanine buckles 30° out of plane of the other guanines.5 Second, the GAAAA junction between the P1 duplex and the quadruplex of Mango-II appears to have more hydrogen bonding interactions than that of Mango-I (FIG. 51). Consistent with a higher stability of the Mango-II junction, all P1 helices in the A.U. are crystallographically resolved. In contrast, only one of the two P1 s in the Mango-! A.U. exhibited electron density. Third, the T1 G-quartet (distal from the fluorophore) of Mango-II is augmented into a hexad by two adenines, A14 and A25 (FIG. 38A). The corresponding T1 in Mango-I is augmented by one adenine into only a pentad. 5 The higher stability of Mango-II may reflect the higher temperature at which it was selected (45° C. vs. 37° C. for Mango-I).

The five adenines in the four propeller loops and the planar T3 quadruplex they create together define the fluorophore binding pocket of Mango-II. In this complex, the MQ and BzT of TO1-Biotin are coplanar and, in chains A and B, stack on G13 and G29 of T3, respectively (FIG. 39A). The binding modes of the headgroup of the fluorophore in the Mango-I and Mango-II complexes are near-mirror images. When seen from above the plane of T3, the BzT and MQ heterocycles are arranged clockwise and counter-clockwise in the two structures, respectively. As a result, the long axes of the BzT and MQ heterocycles are parallel and perpendicular to those of the T3 guanines on which they stack in the Mango-I and Mango-II complexes, respectively (ref. 5, FIG. 40). The perpendicular stacking arrangement is also present in chain C of the Mango-II structure but the heterocycles of the fluorophore are rotated by 90° around the 4-fold symmetry axis of the G-quartet with respect to that found in the A and B chains (FIG. 39B). Concomitant with this rotation, four of the flap adenines of chain C of the A.U. (A17, A22, A23, and A28) adopt different conformations from those of chains A and B (FIG. 3B). A17 reorients from anti to syn; A22 and A28 become disordered; and A23 reorients from syn to anti. In additional contrast to the Mango-I structure, electron density for atoms 1' through 7' of the PEG linker is coplanar with the T3 guanine layer, with the biotin moiety being disordered in all three complexes. The increased coplanarity of the TO1 heterocycles is consistent with the higher quantum yield of Mango-II-TO1-Biotin complex (0.21 vs. 0.14 for the corresponding Mango-I complex).

In the structure of Mango-II bound to TO3-Biotin, electron density corresponding to the fluorophore was only observed for the headgroup (BzT, MQ, and the trimethine linker), and only in RNA chains A and B (FIGS. 39 C,D). Notably, in the two RNA chains with bound TO3-Biotin, the nucleobase of A22 stacks directly on G24 of T3. In chain B, A22 also is in van der Waals contact with the methine linker of TO3-Biotin. These interactions may further stabilize the complex, and the packing of A22 observed in chain B may directly promote fluorescence of TO3-Biotin by stabilizing a coplanar conformation BzT, MQ, and the extended methine linker of this fluorophore.

Highly selective fluorogenic RNAs would facilitate development of orthogonal fluorescent tags. The structural heterogeneity revealed by our Mango-II TO1-Biotin and TO3-Biotin co-crystal structures, as well as the comparable affinity of the aptamer for the two fluorophores, suggests that the fluorophore binding pocket of this aptamer is not highly stereoselective. To increase selectivity of Mango-II, we constructed mutants focusing on residue A22, which in our structures is conformationally plastic and appeared to have the most potential to influence TO3-Biotin discrimination. Mutants were analyzed for affinity and fluorescence enhancement of TO1-Biotin and TO3-Biotin (Table 8 & 9). Mutation to guanine reduced the binding affinity and fluorescence enhancement of both TO1-Biotin and TO3-Biotin (Table 8 & 9). Such an outcome is not unexpected, as G-quadruplex nucleic acids can undergo alternative folding when additional guanine bases are present.8 However, mutation to uridine or cytosine maintained the binding affinity for TO1-Biotin (0.9 nM) while decreasing the affinity of TO3-Biotin from ~1.4 nM to ~5.0 nM (Table 8 & 9). Unexpectedly, these mutations also increased the fluorescence enhancement of TO1-Biotin by 18% while decreasing the fluorescence enhancement of TO3-Biotin by 25% (Table 8 & 9).

TABLE 7

Summary of crystallographic statistics

| | Mango-II-A22U-TO1 |
|---|---|
| Data collection | |
| Space group | $C222_1$ |
| Cell dimensions | |
| a, b, c (Å) | 36.86, 181.03, 109.06 |
| α β, γ (°) | 90, 90, 90 |
| Resolution (Å) | 46.38-2.80 (2.95-2.80)[a] |
| $R_{merge}$ | 0.102 (0.956) |
| $<I>/<\sigma(I)>$ | 18.6 (1.1) |
| Completeness (%) | 99.8 (99.6) |
| Redundancy | 11.3 (8.7) |
| Refinement | |
| Resolution (Å) | 46.38-2.80 (2.95-2.80) |
| No. reflections | 9216 (1254) |
| $R_{work}/R_{free}$ | 18.59/23.69 |
| No. atoms | 2511 |
| RNA | 2349 |
| TO1-Biotin | 162 |
| Ions | 8 |
| Water | 0 |
| B-factors (Å$^2$) | 59.34 |
| RNA | 59.37 |
| TO1-Biotin | 58.74 |
| Ions | 54.6 |
| Water | N.A. |
| R.m.s deviations | |
| Bond lengths (Å) | 0.008 |
| Bond angles (°) | 1.55 |

[a]Values in parentheses are for highest-resolution shell.
One crystal was used for each data

TABLE 8

Binding and fluorescence of Mango-II and mutants to TO1-B and its derivatives.

| RNA | Ligand | $K_D$ (nM) | $FI_E$ |
|---|---|---|---|
| Mango II - WT | TO1-B | 1.1 ± 0.3 | 1303 ± 20 |
| Mango II - A22U | TO1-B | 0.9 ± 0.4 | 1543 ± 24 |
| Mango II - A22C | TO1-B | 0.9 ± 0.2 | 1407 † |
| Mango II - A22G | TO1-B | 6.4 ± 1.5 | 1224 † |
| Mango II - WT | TO3-B | 1.4 ± 0.3 | 61 ± 2 |
| Mango II - A22U | TO3-B | 5.0 ± 2.8 | 46 ± 3 |
| Mango II - A22C | TO3-B | 5.1 ± 1.4 | 37 † |
| Mango II - A22G | TO3-B | 7.6 ± 3.7 | 52 † |
| Mango II - A12U | TO1-B | 0.40 ± 0.07 | 1342 † |
| Mango II - A17U | TO1-B | 1.00 ± 0.16 | 1237 † |
| Mango II - A15U A20U A25U A26U A31U | TO1-B | 1.92 ± 0.39 | 1133 † |
| Mango II - A15U A20U A25U | TO1-B | 0.76 ± 0.24 | 1329 † |
| Mango II - WT | TO1-OAc | 56 ± 2 | 258 ± 10 |
| Mango II - A22U | TO1-OAc | 43 ± 3 | 315 ± 4 |
| Mango II - WT | TO1-ME | 2.41 ± 0.54 | 401 ± 6 |
| Mango II - A22U | TO1-ME | 4.81 ± 1.02 | 302 ± 6 |
| Mango II - WT | TO1-PA | 1.04 ± 0.57 | 493 ± 5 |
| Mango II - A22U | TO1-PA | 2.21 ± 1.09 | 275 ± 3 |

TABLE 8-continued

Binding and fluorescence of Mango-II and
mutants to TO1-B and its derivatives.

| RNA | Ligand | $K_D$ (nM) | $FI_E$ |
|---|---|---|---|
| Mango II - WT | TO1-PE | 0.37 ± 0.06 | 783 ± 13 |
| Mango II - A22U | TO1-PE | 1.00 ± 0.13 | 825 ± 14 |

† Indicates the fluorescence enhancement was calculated relative to wt from the binding titration.

To understand how the Mango-II A22U mutation results in increased TO1-Biotin fluorescence enhancement, we determined the co-crystal structure of this complex at 2.8 Å resolution (Table 7). The RNA structure is generally unchanged from that of the wild-type. The nucleobase of U22 is ordered but projects into solvent rather than interacting with T3. TO1-Biotin adopts the same orientation in all three chains in the A.U. with Bzt and MQ stacking on G29 and G13, respectively (FIGS. 39 E,F). Among our crystal structures, the binding pocket of the mutant is better ordered than that of either wild-type complex as judged by the mean real-space correlation coefficient (Table 10). Ligand-RNA shape complementarity (SC) analysis9 of each co-crystal structure indicates that the A22U binding pocket conforms to TO1-Biotin better than wildtype, with SC statistics of 0.796 (rms=0.004) and 0.750(rms=0.009), respectively. The SC statistic of Mango-II-TO3-Biotin complex, 0.800 (rms=0.019), was similar to that of Mango-II (A22U)-TO1-Biotin.

TABLE 9

RNA sequence table.

| # | RNA Name | Sequence | SEQ ID NO |
|---|---|---|---|
| 1 | Mango II-wt | GCGUACGAAG GAGAGGAGAG GAAGAGGAGA GUACGC | 6902 |
| 2 | Mango II-A22U | GCGUACGAAGGAGAGGAGAGGUAGAGGAGAGU ACGC | 6903 |
| 3 | wt* (8 bp) | GGCACGUACGAAGGAGAGGAGAGGAAGAGGAG AGUACGUGC | 6904 |
| 4 | A22U* | GGCACGUACGAAGGAGAGGAGAGGUAGAGGAG AGUACGUGC | 6905 |
| 5 | A22C* | GGCACGUACGAAGGAGAGGAGAGGCAGAGGAG AGUACGUGC | 6906 |
| 6 | A22G* | GGCACGUACGAAGGAGAGGAGAGGGAGAGGAG AGUACGUGC | 6907 |
| 7 | A12U* | GGCACGUACGAAGGUGAGGAGAGGAAGAGGAG AGUACGUGC | 6908 |
| 8 | A17U* | GGCACGUACGAAGGAGAGGUGAGGAAGAGGAG AGUACGUGC | 6909 |
| 9 | A15U A20U A25U A26U A31U* | GGCACGUACGAAGGUGAGGUGAGGUUGAGGU GAGUACGUGC | 6910 |
| 10 | A15U A20U A25U* | GGCACGUACGAAGGUGAGGUGAGGUAGAGGAG AGUACGUGC | 6911 |

TABLE 10

Mean CC values for binding pocket residues
in respective complexes and chains.

| | Mango-II-TO1 | Mango-II-TO3 | Mango-II-A22U-TO1 |
|---|---|---|---|
| Chain A | 0.9282 | 0.9433 | 0.9605 |
| Chain B | 0.9181 | 0.9201 | 0.9431 |
| Chain C | 0.8606 | 0.8790 | 0.9248 |

Binding pocket residues are defined as G13, G18, G24, G29, A12, A17, A22, A23 and A28

To extend our crystallographic observations into solution conditions, we examined the fluorescence lifetimes of the wildtype and A22U mutant Mango-II RNAs in complex with TO1-Biotin. The A22U mutation increases the average lifetime of the emission from 1.51 (±0.06) ns to 1.92 (±0.03) ns. The lifetime of the Mango-II-TO1-Biotin complex has two components, and both are increased in the mutant compared to the wild-type: the first from 0.52 (±0.02) ns to 0.72 (±0.01) ns, and the second from 2.33 (±0.12) ns to 2.904 (±0.001) ns (FIG. 41, Table 11). Our X-ray structures show that the wild-type Mango-II has two different modes of TO1-Biotin binding, while the A22U mutant is more homogeneous (FIG. 39). The longer lifetimes of the mutant are consistent with this, and in particular suggest reduced torsional freedom in the atoms of the methine linker, as has been shown previously for other complexes of thiazole orange with nucleic acids.10

TABLE 11

Parameters from the analysis of fluorescence lifetime data.

| Parameter | TO1-Biotin | Mango II wt | Mango II A22U |
|---|---|---|---|
| $\tau_1$ (ns) | 0.11 | 0.52 (±0.02) | 0.72 (±0.01) |
| $\alpha_1$ (%) | 63 | 45 (±3) | 45 (±2) |
| $\tau_2$ (ns) | 0.50 | 2.33 (±0.12) | 2.904 (±0.001) |
| $\alpha_2$ (%) | 25 | 55 (±3) | 55 (±2) |
| $t_3$ (ns) | 2.63 | \ | \ |
| $\alpha_3$ (%) | 12 | \ | \ |
| $\tau_i$ (ns) * | 1.77 | 2.05 (±0.09) | 2.53 (±0.02) |
| $\tau_a$ (ns) * | 0.51 | 1.51 (±0.06) | 1.92 (±0.03) |

* $\tau_i$ is the intensity-weighted average lifetime, and $\tau_a$ is the amplitude-weighted average lifetime calculated from the data presented above. The latter is used in the text when discussing and comparing the TCSPC data for the different structures.

The Inventor's mutant co-crystal structure shows no direct contacts between U22 and TO1-Biotin. To gain further insight into how the U22 mutation improves Mango-II properties, we examined the effect of varying the length of the linker between the thiazole orange and biotin moieties of TO1-Biotin. We determined the affinity and fluorescence enhancement of four compounds: TO1-OAc (TO1-acetate), TO1-ME (TO1-methylester), TO1-PA (TO1-propanylamide), TO1-PE (TO1-pentenoylester) (FIG. 42, Table 8 & 9). Binding affinity and fluorescence enhancement of TO1-OAc is drastically diminished, and nearly identical between the wild-type and A22U mutant. However, the TO1-ME and TO1-PA exhibit greater fluorescence enhancement and binding affinity with the wild-type than with A22U. This suggests that in the absence of an extended linker, the A22 stabilizes the binding pocket, presumably by stacking on G24 as observed in chain B of the Mango-I-TO3-Biotin co-crystal structure (FIGS. 39 C,D). Further extension of the linker stabilizes the binding pocket by stacking on T3 but becomes sterically hindered by a bulky purine in position 22. The A22U mutation would limit steric clashes while preventing misfolding of the G-quadruplex core. Thus, the improved properties of the Mango-II A22U mutant may arise from improved packing of the linker of the fluorophore with an RNA with a homogeneous or predominant conformation.

The inventors demonstrate that Mango-II is a versatile platform for fluorescence enhancement of thiazole-orange derived fluorophores, and have shown that variants of this RNA tag, designed with the aid of crystal structures, have improved properties. Analysis of the fluorophore-RNA shape complementarity of each of our structures reveals that fluorescence enhancement correlates directly with the SC statistic. The Mango-II-TO3-Biotin and Mango-II(A22U)-TO1-Biotin complexes both yield similarly high SC statistics, possibly indicating an upper limit to the shape complementarity attainable for this type of complex. The high SC statistic observed for the A22U mutant-TO1-Biotin complex also correlates with improved binding affinity, fluorescence enhancement and fluorescence lifetime. Fluorescence binding studies on TO1-Biotin variants independently suggest that these improvements are due to removal of steric constraints on the ligand by the transversion mutation to a pyrimidine, consistent with our crystallographic analysis. By achieving enhanced fluorescence properties through improved ligand-RNA packing and structural homogeneity, this work demonstrates that even functionally selected fluorogenic RNAs can potentially be improved through detailed structural and mechanistic analysis.

REFERENCES

1. Paige, J. S.; Wu, K. Y.; Jaffrey, S. R., RNA mimics of green fluorescent protein. Science 2011, 333 (6042), 642-646.
2. Dolgosheina, E. V.; Jeng, S. C. Y.; Panchapakesan, S. S. S.; Cojocaru, R.; Chen, P. S. K.; Wilson, P. D.; Hawkins, N.; Wiggins, P. A.; Unrau, P. J., RNA Mango aptamer-fluorophore: A bright, high-affinity complex for RNA labeling and tracking. ACS Chem. Biol. 2014, 9 (10), 2412-2420.
3. Tan, X. H.; Constantin, T. P.; Sloane, K. L.; Waggoner, A. S.; Bruchez, M. P.; Armitage, B. A., Fluoromodules consisting of a Promiscuous RNA aptamer and red or blue fluorogenic cyanine dyes: selection, characterization, and bioimaging. J. Am. Chem. Soc. 2017, 139 (26), 9001-9009.
4. Rodriguez, E. A.; Campbell, R. E.; Lin, J. Y.; Lin, M. Z.; Miyawaki, A.; Palmer, A. E.; Shu, X. K.; Zhang, J.; Tsien, R. Y., The growing and glowing toolbox of fluorescent and photoactive proteins. Trends Biochem. Sci. 2017, 42 (2), 111-129.
5. Trachman, R. J.; Demeshkina, N. A.; Lau, M. W. L.; Panchapakesan, S. S. S.; Jeng, S. C. Y.; Unrau, P. J.; Ferré-D'Amaré, A. R., Structural basis for high-affinity fluorophore binding and activation by RNA Mango. Nat Chem Biol 2017, 13 (7), 807-813.
6. Trachman, R. J.; Truong, L.; Ferre-D'Amare, A. R., Structural principles of fluorescent RNA aptamers. Trends Pharmacol. Sci. 2017, 38 (10), 928-939.
7. Autour A et al., Fluorogenic RNA Mango aptamers for imaging small non-coding RNAs in mammalian cells Nat. Comm. 2018 (In Press), DOI: 10.1038/s41467-018-02993-8.
8. Phan, A. T.; Kuryavyi, V.; Gaw, H. Y.; Patel, D. J., Small-molecule interaction with a five-guanine-tract G-quadruplex structure from the human MYC promoter. Nat. Chem. Biol. 2005, 1 (3), 167-173.
9. Lawrence, M. C.; Colman, P. M. Shape complementarity at protein/protein interfaces. JMB 1993, 234, 946-950.
10. Jarikote, D. V.; Krebs, N.; Tannert, S.; Roder, B.; Seitz, O., Exploring base-pair-specific optical properties of the DNA stain thiazole orange. Chem. Eur. J. 2007, 13, 300-310.
11. Leontis, N. B.; Westhof, E., Geometric nomenclature and classification of RNA base pairs. RNA 2001, 7 (4), 499-512.

Example 2—an RNA Aptamer of Unusual Structural Complexity Induces Bright Fluorescence of a Thiazole Orange Derivative In order to elucidate the molecular basis for the unusually bright fluorescence of the Mango-III-TO1-Biotin complex, and as a starting point for structure-guided optimization of this tool for live-cell imaging of RNAs, we have now determined its co-crystal structure at 2.35 Å resolution, revealing a compact aptamer RNA of unusual structural complexity. The thiazole orange (TO) headgroup of the fluorophore is constrained between a long-range Watson-Crick base pair and a G-quadruplex to a planar conformation that would maximize its fluorescence, thereby explaining the high quantum yield of Mango-III.

Results

Overall Structure of Mango-III Bound to TO1-Biotin

A 38-nt construct comprising the conserved 28-nt Mango-III core flanked by nucleotides presumed to form a 5-base pair Watson-Crick duplex was co-crystalized with TO1-Biotin. The structure was solved by the single-wavelength anomalous dispersion (SAD) method using data from an iridium derivative (Table 12, Methods).

TABLE 12

Summary of crystallographic statistics

| | Mango-III-TO1 | Mango-III-A15U-TO1 | SuperMango-III-TO1 |
|---|---|---|---|
| Data collection | | | |
| | | | |
| Space group | $P2_12_12_1$ | H3 | $I4_122$ |
| Cell dimensions | | | |
| | | | |
| a, b, c (Å) | 63.03, 67.59, 76.67 | 91.95, 91.95, 161.69 | 53.27, 53.27, 188.04 |
| α β, γ (°) | 90, 90, 90 | 90, 90, 120 | 90, 90, 90 |
| Resolution (Å) | 46.10-2.35 (2.39-2.35)$^a$ | 45.97-2.90 (2.98-2.90)$^a$ | 40.59-1.51 (1.55-1.51) |
| $R_{merge}$ | 0.06 (>1) | 0.038 (0.91) | 0.05 (>1) |
| $<I>/<\sigma(I)>$ | 50.6 (1.2) | 10.3 (1.0) | 20.9 (1.5) |
| Completeness (%) | 99.9 (100) | 98.5 (99.0) | 99.9 (98.6) |
| Redundancy | 7.2 (7.1) | 2.3 (2.2) | 10.2 (10.6) |

TABLE 12-continued

Summary of crystallographic statistics

| | Mango-III-TO1 | Mango-III-A15U-TO1 | SuperMango-III-TO1 |
|---|---|---|---|
| Refinement | | | |
| Resolution (Å) | 38.3-2.35 (2.43-2.35) | 45.98-2.90 (3.03-2.90) | 40.59-1.55 (1.61-1.55) |
| No. reflections | 12717 (1237) | 11055 (1224) | 20013 (1951) |
| $R_{work}/R_{free}$ | 19.28/20.92 | 19.29/23.07 | 16.8/19.12 |
| No. atoms | 1806 | 3171 | 996 |
| RNA | 1632 | 2283 | 787 |
| TO1-Biotin | 107 | 93 | 52 |
| Ions | 9 | 5 | 8 |
| Water | 25 | 4 | 143 |
| B-factors (Å$^2$) | 76.8 | 79.75 | 33.90 |
| RNA | 76.91 | 80.17 | 32.07 |
| TO1-Biotin | 74.29 | 67.45 | 34.09 |
| Ions | 79.7 | 65.02 | 33.35 |
| Water | 79.1 | 58.93 | 41.81 |
| R.m.s deviations | | | |
| Bond lengths Å | 0.006 | 0.007 | 0.005 |
| Bond angles | 1.265 | 1.541 | 1.06 |

[a]Values in parentheses are for highest-resolution shell. One crystal was used for each data set.

Figure 44:
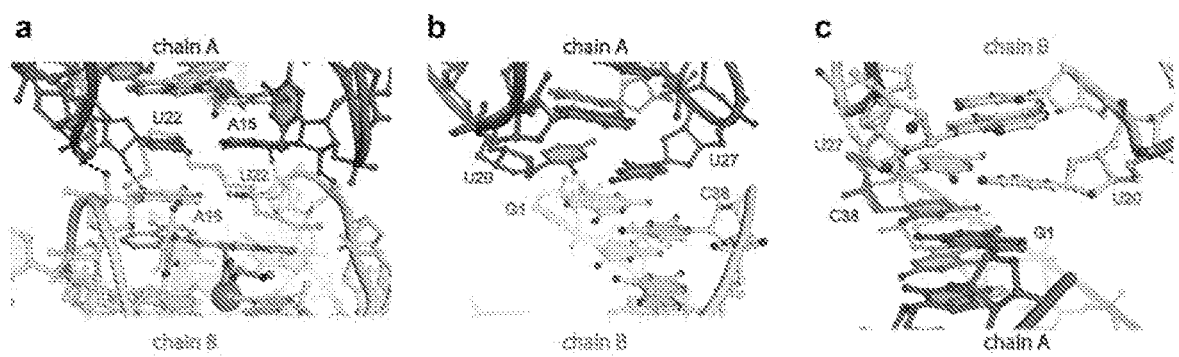
Figure 45:
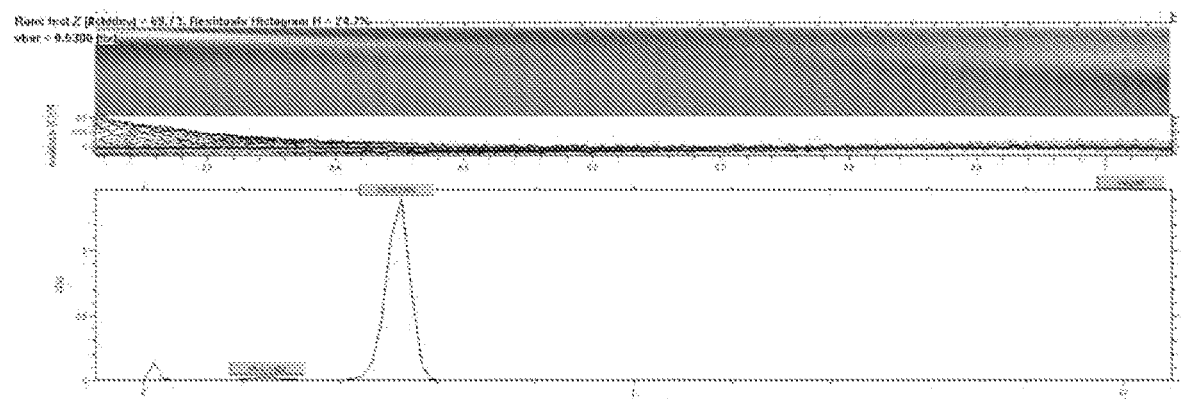

The crystallographic asymmetric unit (ASU) contains two similar RNA-fluorophore complexes (RMSD=0.15 Å for all non-hydrogen atoms). The two RNAs in the ASU each make three crystal contacts involving duplex stacking (FIG. 44). Analytical ultracentrifugation and dynamic light scattering (FIG. 45) however, indicate that Mango-III is a monomer in solution.

Figure 46D:
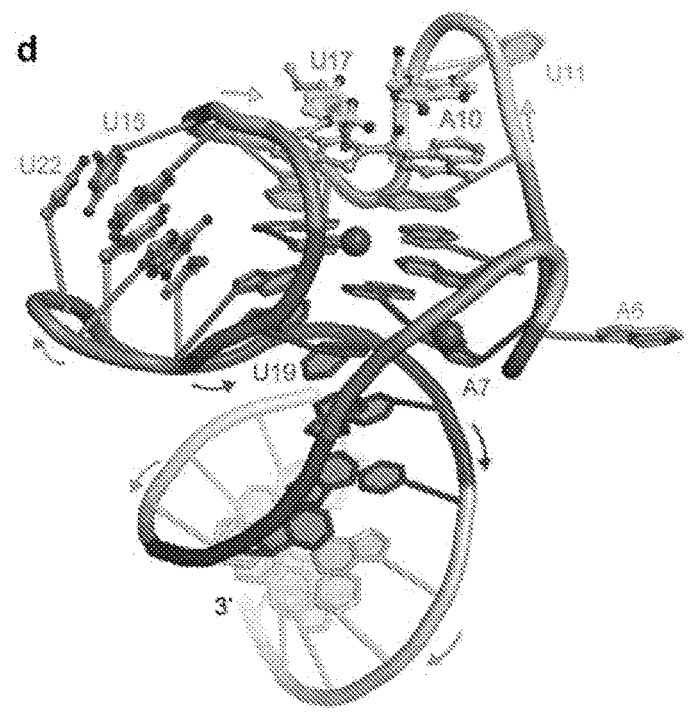

The structure of Mango-III (FIG. 46 b,c) is organized around a two-tiered G-quadruplex with all-parallel connectivity, except for G18 of the top tier (T2), which is antiparallel. This quadruplex, which coordinates a canonical axial K+ ion (MA), stacks on a base triple, which in turn stacks coaxially on an A-form duplex (paired element P1). Two nucleotides from the loop connecting G14 and G18 of T2, and four nucleotides from the loop that follows G20 (the last of the eight guanines of the G-quadruplex) form the three base pairs of a second helix (P2) that is juxtaposed with the G-quadruplex. U17, which is extruded from the middle of P2, forms a trans Watson-Crick pair with A10 from the propeller loop that connects G9 to G13, on the diagonally opposite side of the T2 G-quartet. The benzothiazole (BzT) and methylquinoline (MQ) of the bound TO1-Biotin are sandwiched between the A10•U17 tertiary base pair and T2 of the G-quadruplex. Reflecting the high structural complexity of this aptamer RNA, only two nucleobases (A6, U11) of the 28-nucleotide conserved core of Mango-III do not share at least a hydrogen bond with another nucleobase. In comparison, six of the 22 nucleotides of the Mango-I core are fully unpaired (FIG. 46 c).

A coaxial duplex-triplex-quadruplex stack Mango-I is comprised of a three-tiered G-quadruplex flexibly connected to its adjacent A-form duplex P1 through a GAA"A-tetraloop-like junction (A denotes the site of insertion of the quadruplex). The corresponding residues of Mango-III adopt a completely different structure. Instead of folding like the first three nucleotides of a GNRA tetraloop, G1, A2 and A3 of Mango-III continue the duplex structure of P1 by Watson-Crick base-pairing with complementary nucleotides at the 3' end of the aptamer (FIG. 46 d). A25 of Mango-III (which corresponds in sequence to the last tetraloop residue of Mango-I) forms an expanded base triple with A7 (which is part of the propeller loop between G5 and G8 of the Mango-III quadruplex) and U19 (which connects G18 an G20 of the Mango-III quadruplex) (FIG. 46 b, FIG. 47a). The A7•U19•A25 triple is unusual because only two direct hydrogen bonds connect the three nucleobases, but these each also hydrogen bonds through its Watson-Crick face to a common water molecule (W1) that lies approximately at the center of the triple.

The expanded A7•U19•A25 triple links the P1 duplex with the quadruplex of Mango-III through three sets of interactions. First, the base triple stacks below the T1 of the quadruplex and above the closing A3•U26 base pair of P1. Second, the 2'-OH of U26 donates a hydrogen bond to the N1 of A7 of the triple, in effect expanding it to a pseudo-tetrad. Third, a hydrated cation (MB, Sr2+ in this crystal structure, but likely Mg2+ under physiological conditions) and a network of ordered water molecules connects the phosphate of A7 to the minor grooves of both, A3 and G4, thereby spanning the duplex-quadruplex junction. Overall, these interactions likely produce a rigid connection between P1 and the G-quadruplex moieties of Mango-III, which is consistent with the identical (within coordinate precision) relative arrangements of the two elements in the two crystallographically independent aptamer RNAs in the A.U.

A Partially Parallel Non-Canonical Duplex

The P2 duplex of Mango-III is unique because of the chain direction of its two strands, and because each of its three base pairs is non-canonical. The backbones of the trans Watson-Crick U15•U22 and trans Hoogsteen A16•A23 base pairs are parallel. The third base pair is formed between U24 and G21, whose backbones are locally anti-parallel, being on opposite ends of the same loop connecting G20 of T1 (the last guanine of the G-quadruplex) to A25 of the base triple. The G21•U24 pair is formed in cis, and comprises a single hydrogen bond. The unusual structure of the P2 duplex is reflected in variable C1'-C1' distances (8.5 Å, 11.4 Å and 12.6 Å for the three pairs) that differ from that typical for canonical antiparallel A-form RNA duplexes (10.7 Å), and appears to be stabilized by a cross-strand stacking of A16 on G21. This latter interaction gives rise to two reciprocal hydrogen bonds between the N1 of A16 and the 2'-OH of G21, and the O6 of G21 and the 2'-OH of A16.

Formation of a duplex such as P2 between nucleotides in a propeller loop of a G-quadruplex and residues 3' to it is unusual. P2 contributes to the overall structure of Mango-III and formation of its fluorophore binding pocket in three important ways. First, because P2 is followed immediately by A25, formation of the duplex anchors the 2-tiered G-quadruplex onto the base triple. Second, G18 and G20 form the only non-contiguous and anti-parallel guanine stack in the Mango-III G-quadruplex, and P2 anchors the backbones of these two nucleotides next to each other. This may be further facilitated by a hydrogen bond between the pro-Rp non-bridiging phosphate oxygen (NBPO) of U10 and the 2'-OH of G14 from the adjacent guanine stack (FIG. 49 a). Third, P2 helps position U17 of the tertiary base pair in the fluorophore binding pocket of Mango-III, where it plays a functionally essential role.

The TO1-Biotin-Binding Site of Mango-III

Unbiased residual electron density corresponding to the BzT and MQ heterocycles as well as the four proximal atoms of the PEG linker of TO1-Biotin unambiguosly located the TO headgroup between T2 of the G-quadruplex and the tertiary A10•U17 trans Watson-Crick base pair (FIG. 49 b) A strong anomalous difference Fourier feature corroborated the location of the sulfur atom of BzT. Unlike in its Mango-I complex, where the planes of BzT and MQ subtended a 45° angle, and the biotin moiety stacked on the G-quadruplex and hemmed in the MQ ring, when bound to Mango-III the BzT and MQ rings are either coplanar (chain B) o modestly angled (23°, chain A), and the biotin projects out into solvent where it is presumed disordered. A further distinction between the Mango-I and Mango-III complexes is that whereas in the former the sulfur of BzT projects outward from the quadruplex, it lies at the center of T2 in the latter, where it is in van der Waals contact with the 06 of G18.

To test the functional significance of the tertiary A10•U17 base pair of Mango-III, we generated all sixteen combinations of nucleotides at these two positions, and examined their effect on TO1-Biotin binding and fluorescence enhancement (FIG. 52). With one exception, these mutations resulted in a least a 10-fold decrease in binding affinity and more than a 24% loss in fluorescence enhancement. The exception was the A10U point mutant, which not only exhibited TO1-Biotin binding affinity indistinguishable from that of the Mango-III wild-type, but also a 22% higher fluorescence enhancement. Thus, the tertiary base pair of Mango-III is important for fluorescence enhancement, and two of the sixteen possible nucleotide pairs yield bright fluorescence. Binding of TO1-Biotin to Mango-III appears to be further stabilized by U12, whose nucleobase is perpendicular to the T2 and A10-U17 planes, and where it hydrogen bonds through its N3 to the N3 of A10 and through its 2'-OH to the pro-Sp NBPO of G14 (FIG. 49 a,b). The nucleobase of this perpendicular U12 is in van der Waals contact with the proximal atoms of the PEG linker of TO1-Biotin. Previous characterization of Mango-III showed that the U12C mutant was 40% less fluorescent. We made the U12A and an abasic residue 12 variants, and found that they exhibited greater than 10-fold loss of affinity and greater than 45% loss in fluorescence enhancement. Thus, U12 appears to provide optimal interactions, both intramolecular and with the bound fluorophore.

Structure of the Enhanced Mango-III(A10U) Mutant

To determine the structural basis of the improvement in fluorescence resulting from the A12U mutation of Mango-III, we determined the crystal structure of this variant in complex with TO1-Biotin at 2.9 Å resolution (Table 1, Methods, and FIG. 4c, d). The mutant crystallized with four independent aptamer-fluorophore complexes in the A.U. The overall structures of the four chains are similar, but two of them (chains B and D) have partially disordered P2 helices where the cross-strand-stacked A16 and G21 are ordered, but U15, A23 and U24 are partially disordered. In all four chains, the U10 base resulting from the mutation forms a trans Watson-Crick pair with U17. The C1'-C1' distance of the U10•U17 base pair of the mutant (11.1 Å) is largely unchanged from that of the A10•U17 pair of the wild-type Mango-III (11.2 Å).

In both structures, N3 of U17 donates a hydrogen to bond with either N3 of the wild type A15 or 02 of U15. The distance of this hydrogen bond decreases from ~2.95 Å in the wild type structure to ~2.7 Å in the A15U mutant. This further reduces the overlap of the nucleotide in position 15 with the methylquinoline. As a result, TO1-Biotin is observed in two distinct conformations in the ASU of the A15U mutant, with two copies found in the E conformation and two copies in the Z conformation (FIG. 48 C). Both TO1-Biotin fluorophores in the wild type structure are in the Z-conformation.

The mutant base pair results in reduced overlap with the ligand. This is consistent with fluorescence binding data showing that the more extended TO3-Biotin fluorophore is disrupted by pyrimidine substitutions in the cap and favored by purine substitutions (FIG. 52). Interestingly, Mango-III and the Mango-III A15U mutant bound to a broad set of TO1 fluorophore derivatives (FIG. 53) in contrast to Mango-I.

Structure Guided Reselection of Mango-III

Given the improved fluorescence enhancement observed in the A22U mutant and the detrimental effects of mutagenesis to T1' and T1, as well as the structurally implied instability of these two regions, we hypothesized that structure guided reselection would improve the fluorescence enhancement and or stability of the Mango-III aptamer. A starting pool of $4.1 \times 10^6$ sequences was generated by mixing two RNA pools in equal proportion, with the first pool (pool 1) randomized at ten positions in the conserved Mango-III core (8, 12, 15, 17, 22, 24, 26, 29, 30, 31) and the second pool (pool 2) randomized at the same positions as pool 1 with an additional random insertion 3' to position 31 to potentially allow for a canonical G-tetrad to form. An engineering work flow was implemented consisting of one round of SELEX*, to enrich high affinity aptamers, followed by seven rounds of IVC to select for bright aptamers. The selection converged on five sequences with frequencies of 58%, 12%, 8.5%, 1.2% and 0.4% (FIG. 50). Identical to the Mango-III-A15U mutant, all five sequences possessed uridines at binding pocket positions 15, 17, and 22 indicating that the rationally designed A15U mutant is optimal for fluorescence enhancement. However, all five sequences contained the insertion 3' to position 31 as well as mutations in the helix-T1 junction, T1, and T1' indicating that the region distal from the binding pocket is indeed suboptimal.

The inter-tier interactions of A21 and G26 appear to be the most stable in P2. This interaction network is observed in all six protamers of our two structures, whereas two protamers in the ASU of Mango-III-A15U show U20, A28, and U29 in an unfolded state. However, even the unfolded conformations in the Mango-III (A15U)-TO1-Biotin complex resolve the pro-RP oxygen of U20 hydrogen bonding to the 02' of G19, suggesting that the nucleotide in the 20 position can promote a stable binding-pocket regardless of base composition. Indeed, mutagenesis of the bases in P2 show that T3' is the most tolerant to nucleotide changes, with TO1-Biotin Kds ranging from 1.6 nM to 9.7 nM. while mutagenesis of P2' and P1' exhibit Kds ranging from 140 nM to 250 nM. Seeing as the A21 residue is adjacent to the cap nucleotide U22, the binding of fluorophore may couple folding of both U22 and A21. These binding data support the importance of A21 and G26 in stabilizing the fluorophore binding pocket and the precarious nature of U29, given its location adjacent to the mixed tetrad, T1.

Methods

Crystallography

RNAs were chemically synthesized (Dharmacon); deprotected according the manufacturers protocol and gel purified. RNAs were exchanged into 20 mM MOPS-KOH pH 7.0, 150 mM KCl and 10 µM EDTA through centrifugal ultrafiltration (3,000-Da cutoff, Millipore); filtered (0.1 µm cutoff, Amicon Ultrafree-MC, Millipore); and stored at 4° C. Some RNAs were in vitro transcribed and purified by electrophoresis on 14% polyacrylamide (19:1 acrylamide/bisacrylamide), 1×TBE, 8M Urea gels; electroeluted from gel slices; washed once with 1M KCl; desalted by ultrafiltration and a partial list appears in FIG. 52.

Crystallization of Mango-III-TO1-Biotin was performed by heating RNA 1 (20 mM MOPS-KOH pH 7.0, 150 mM KCl, 10 µM EDTA) to 95° C. for 3 minutes, placed at 21° C. for 10 minutes, mixed with equimolar concentration of TO1-Bitoin then kept at 21° C. for 30 minutes. For crystallization, 0.2µ of RNA solution (300 µM) and 0.2 µl reservoir solution were mixed and equilibrated against 0.04 M Na Cacodylate pH 6.5, 0.08 M NaCl, 0.012 M KCl, 0.02 M $MgCl_2$, 0.012 M Spermine·4 Cl, 5.5% Sucrose, 31% MPD. Strongly fluorescent (500 nm illumination), tretraganol pyramidal crystals grew in 1-3 days to maximum dimensions of 300×100×100 µm³. Additional cryoprotection was not necessary prior to mounting the crystal in a nylon loop and vitrifying by plunging into liquid nitrogen. Data collection was performed under a cryo-cooled nitrogen stream at APS 22-BM with a beam wavelength of 0.977 Å as well as APS 24-ID-C at 1.495 Å resulting in data sets with a maximum resolution of 2.35 Å. Data were reduced in HKL2000 with 10% of reflections flagged for $R_{Free}$ calculation. Phases were obtained by soaking crystals in drop conditions above supplemented with 10 mM Iridium hexamine for 90 minutes and then vitrifying by plunging into liquid nitrogen. Data sets of iridium soaked crystals were collected at APS 22-ID at a wavelength of 0.957 Å. SHELXC reported a significant anomalous signal extending to 3.5 Å from a single crystal diffracting to 3.2 Å. Two heavy atom sites were located by SHELXD with density modification performed in SHELXE resulting in an uninterpretable map. Sites from SHELXD were loaded into AutoSol resulting in phase solution with a figure of merit of 0.22. The resulting density modified map showed decent density contrast for a helical region allowing for 16 bases to be modeled directly into the SAD map. This model was then refined using Pehnix.refine and molecular replaced into the native data set (2.35 Å resolution) collected at APS 22-BM using the program Phaser, resulting in a TFZ score of 12.1. Manuel building and refinement was performed in Coot and Phenix.refine, respectively, using the HL coefficients generated from the Iridium dataset as a target.

Mango-III-A15U-TO1-Biotin was crystallized by adding 0.2 µl of RNA 2 solution (300 µM, prepared similarly to above with addition of TO1-Biotin) and 0.2 µl reservoir solution were mixed and equilibrated against 1.6 M Ammonium Citrate, 3.0% glycerol and 4% Acetone. Strongly fluorescent, equilateral triangular rod like crystals, grew in 1-2 days with dimensions of 80×(20×20×20) µm. Supplementation of the growth conditions was not necessary for cryoprotection. Crystals were mounted in a nylon loop and vitrifying by plunging into liquid nitrogen. Data were collected at ALS beamline 502 at a wavelength of 1.105 Å. Data were reduced in DIALS with 5% of reflections being flagged for $R_{Free}$ calculation. Phasing was performed by molecular replacement using the program Phaser with coordinates from the Mango-III-TO1 structure from above with residues 1, 2, 15, 22, 37 and 38 deleted along with the TO1 ligand. A replacement solution was found with a TFZ score of 15.2. Multiple rounds of building and refinement were performed in Coot and Phenix.refine respectively. Simulated annealing was performed every 6 refinement cycles at 5000 K until an $R_{Free}$ of 0.25 was reached. A new set of $R_{Free}$ flags composing 10% of reflections was selected and building and refinement continued with 4 rounds of simulated annealing.

Analytical Ultracentrifugation

Analytical Ultracentrifugation was performed on RNA 1 in the presence and absence of TO1-Biotin. Cells contained RNA Mango at 5 µM concentration in addition to 20 mM MOPS-KOH, pH 7.0, 150 mM KCl, 10 µM EDTA. Samples were prepared as noted above. 500 scans were collected and averaged on a Beckman XLI analytical ultracentrifuge. Absorbance was measured at 295 nm, under constant velocity with a run speed of 60,000 r.p.m. at 20° C. The viscosity and density of the buffer were calculated to be 0.01015 P and 1.0068 g ml⁻¹, respectively, with the Sednterp server (http://rasmb.org/sednterp).

Fluorescence Binding Experiments

RNA Preparation

RNAs 3-10 were in vitro transcribed via run off transcription with oligonucleotides purchased from IDT and purified by electrophoresis on 10% polyacrylamide (19:1 acrylamide/bisacrylamide), 1×TBE, 8M Urea gels; electroeluted from gel slices; washed once with 1M KCl; desalted by ultrafiltration. RNA concentrations were determined by reading the Absorbance at 260 nm on a NanoDrop Spectrophotometer (ThermoFisher Scientific), and using the extinction coefficients determined with the nearest neighbor method using the IDT OligoAnalyzer online tool.

Binding Affinity Measurements

Fluorescence readings were recorded using a Varian Cary Eclipse Spectrophotometer set to measure at the maximum excitation and emission wavelengths of the Mango II aptamer dye complex. Fluorescence titrations were performed in Mango selection buffer (WB: 140 mM KCl, 1 mM $MgCl_2$, 10 mM $NaH_2PO_4$ pH 7.2, 0.05% Tween-20). To determine binding affinity and Fmax, curves were fitted using least squares (Kaleidagraph 4.5) using the following equation for TO1-Biotin:

$$F = F_0 + \frac{F_{max}}{2}\left(K_D + [RNA] + [TO] - \sqrt{([RNA] - [TO])^2 + K_D(K_D + 2[RNA] + 2[TO])}\right)$$

Or to the following equation for TO3-Biotin:

$$F = F_0 + \frac{F_{max}[RNA]}{K_D + [RNA]}$$

Fluorescence Enhancement Measurements

Fluorescence enhancement experiments were performed on a Photon Technologies International/820 Photomultiplier Detection System with an excitation and emission wavelength centered at 510 nm and 535 nm, respectively, for TO1-Biotin and TO1 derivatives while TO3-Biotin excitation and emission were 635 nm and 660 nm, respectively.

The bandwidth for all measurements was 1.5 nm for all experiments. Measurements were performed in a 0.2 cm path length cuvette in a background of 20 mM MOPS pH 7.0, 150 mM KCl, 10 µM EDTA. Fluorescence readings were taken in the absence of RNA at a ligand concentration of 0.82 µM. A concentrated, annealed stock of RNA was then added to the cuvette resulting in a final concentration of 2 µM RNA and allowed to equilibrate for 1 minute prior to taking an emission reading. Fluorescence enhancement was determined by dividing the fluorescence signal of ligand in the presence of RNA by the fluorescence signal in the absence of RNA corrected for the background of the instrument.

Fluorescence Lifetime Measurements

Fluorophore lifetime measurements were performed by using an in-house modified 2-photon fluorescence microscope based on a Zeiss LSM 510 unit capable of Time-Correlated Single-Photon Counting (TCSPC) measurements. A diode-pumped solid state laser (Millenia Prime, Spectra Physics, Newport, Calif.) was used to pump a Ti:Sapphire Tsunami oscillator (Model 3960C, Spectra Physics, Newport, Calif.), operating in femtosecond mode, at a repetition rate of 80 MHz, and tunable in the near infrared region. The output beam of the Ti:Sapphire laser was directed into an acousto-opto modulator (MT110/B50/A1.5 IR/S, AA Optoelectronic, France), controlled through the Zeiss LSM electronics and software, to attenuate the power before steering it into the LSM unit. The beam was reflected onto a 700/488 dichroic mirror and directed into the back aperture of a Plan Apochromat 63×, NA 1.4, oil immersion objective, and expanded to fill the back pupil. The fluorescence from the sample was collected from the same objective, intercepted by a 733LP dichroic mirror, sent toward the back port of the microscope, filtered through an ET700SP-2P filter (Chroma Technologies, Bellows Falls, Vt.) to remove residual scattering from the laser, and further passed through a 540/50 nm bandpass filter (Semrock, Rochester, N.Y.). The fluorescence is finally focused onto the photocathode of a H7422P-40 GaAsP photomultiplier detector (Hamamatsu, Japan). The large NA of the objective contributes to a certain degree of depolarization of the incoming excitation beam, as well as of the detected fluorescence. According to Fisz (J. Chem. Phys. A, 2007 and 2009), this would allow one to omit an analyzer (polarizer) in front of our detector, because magic angle conditions are achieved by using a 45° angle detection (i.e. unpolarized) configuration. The signal from the detector and the synchronization signal from the laser are directed into an SPC150 photon counting card (Becker & Hickl, Germany), controlled by the SPCM64 proprietary software from the manufacturer (Becker & Hickl, Germany). The data were collected with a 12.5 ns time window in TCSPC histogramming mode with 1024 channels, with a width of 12.2 ps each.

For the experiments the laser was tuned at 780 nm, and the power adjusted to 18 mW before the objective lens. RNA samples were diluted to a concentration of ~3-5 µM in buffer. TO-1B was measured at a concentration of 50 µM due to low fluorescence signal of the compound, compared to the RNA-bound version. An 80 µl droplet was deposited onto a #1.5 coverslip, previously treated with BSA to avoid nonspecific binding of RNA to the glass, and covered to avoid evaporation. The excitation was focused ~5 µm above the upper surface of the coverslip to reduce scatter and to avoid collecting signal from molecules immobilized on the glass surface. The beam was kept stationary by using the LSM controller to simply open the excitation shutter, and data were collected until the maximum count in the peak channel of the TCSPC histogram reached $10^4$ photons. Experiments were repeated in triplicate. An instrument response function (IRF) was collected on every day of measurement by recording the second harmonic generation (SHG) signal from crushed urea crystals deposited onto a glass coverslip, in this case the bandpass filter before the detector was substituted with a 440 nm short pass filter to collect the 390 nm SHG. The data collected with the SPCM64 software were stored as *.sdt files for subsequent analysis.

Fluorescence Lifetime Data Analysis

Data were analyzed using the SPCImage software (Becker & Hickl, Germany). The fluorescence decay curves were fit using exponential functions of the form:

$$I(t) = \sum_{i=1}^{n} a_i e^{-t/\tau_i}$$

Where n is at most equal to 3 in our software. The data fitting routine uses a least-square algorithm where the exponential function is first reconvoluted with the measured IRF and then fit to the data. The shift of the IRF for each dataset, as well as a scatter contribution were included as free parameters during fitting. The number of exponentials used to fit the data was adapted in order to minimize the $\chi^2$ value, which together with the randomness of the residuals was used to evaluate the goodness of the fit.

REFERENCES

1. Otwinski, Z. & Minor, W. Processing of X-ray diffraction data collected in oscillation mode. *Methods Enzymol.* 276, 307-326
2. Kabsch, W. XDS. Acta Cryst. D Biol Crystallogr 66, 125-132 (2010)
3. McCoy, A. J. et al. Phaser crystallographic software. *J. Appl. Cryst.* 40, 658-674 (2007)
4. Emsley, P., Lohkamp, B., Scott, W. G. & Cowtan, K. Features and development of Coot. Acta Crystallogr. *D Biol. Crystallogr.* 66, 486-501
5. Adams, P. D. et al. PHENIX: a comprehensive Python-based system for macromolecular structure solution. Acta Crystallogr. D Biol Crystallogr. 66, 213-221 (2010)

SEQUENCE LISTING (7132 sequences)

SEQ ID NO: 1 - RNA, 23 nt, Artificial Sequence
  Mango I aptamer
gaagggacggugcggagaggaga

SEQ ID NO: 2 - RNA, 19 nt, Artificial Sequence
  general consensus
  misc_feature (3)..(3): represents N or no nucleotide
  misc_feature (4)..(4): represents T1 or WGW
  misc_feature (7)..(7): represents #1H or WG
  misc_feature (11)..(11): n is a, c, g, or u
  misc_feature (12)..(12): represents N or no nucleotide
  misc_feature (13)..(13): represents #2 or no nucleotide
  misc_feature (15)..(15): represents  T2 or H
  misc_feature (17)..(17): n is a, c, g, or u
  misc_feature (19)..(19): represents AN@T3 or G wherein @ represents N or no nucleotide
ggnnggnwggnnngngnhn

SEQ ID NO: 3 - RNA, 19 nt, Artificial Sequence
  generic consensus
  misc_feature: definitions according to SEQ ID NO : 2
  misc_feature (3)..(4): n is a, c, g, or u
  misc_feature (7)..(7): n is a, c, g, or u
  misc_feature (11)..(13): n is a, c, g, or u
  misc_feature (15)..(15): n is a, c, g, or u
  misc_feature (17)..(17): n is a, c, g, or u
  misc_feature (19)..(19): n is a, c, g, or u
ggnnggnwggnnngngnhn

SEQ ID NO: 4 - RNA, 21 nt, Artificial Sequence
  generic consensus
  misc_feature (1)..(19): definitions according to SEQ ID NO : 2
ggnwgwggwgwggnnghgnhg

SEQ ID NO: 5 - RNA, 25 nt, Artificial Sequence
  generic consensus
  misc_feature (1)..(1): represent any pair of nucleotides such that, whereinif n is A, then position 25 represents A,G or U; wherein n if is C, then position 25 represents A,G or U; wherein if n is G, then position 25 represents A,G or U; and whereinif  n is U, then position 19
  misc_feature (1)..(1): as defined in SEQ ID NO : 2
  misc_feature (4)..(5): n is a, c, g, or u
  misc_feature (8)..(8): n is a, c, g, or u
  misc_feature (15)..(15): n is a, c, g, or u
  misc_feature (17)..(17): n is a, c, g, or u
  misc_feature (19)..(19): n is a, c, g, or u
  misc_feature (22)..(24): n is a, c, g, or u
  misc_feature (25)..(25): represent any pair of nucleotides such that, whereinif n is A, then position 25 represents A,G or U; wherein n if is C, then position 25 represents A,G or U; wherein if n is G, then position 25 represents A,G or U; and whereinif  n is U, then position 19
nggnnggnhugghangngnhannnn

SEQ ID NO: 6 - RNA, 21 nt, Artificial Sequence
  generic consensus
  misc_feature (3)..(3): represents N or no nucleotide
  misc_feature (14)..(14): n is a, c, g, or u
  misc_feature (15)..(15): represents N or no nucleotide
ggnwgwggwgwggnnghgghg

SEQ ID NO: 7 - RNA, 28 nt, Artificial Sequence
  generic consensus
  misc_feature (10)..(10): n is a, c, g, or u
  misc_feature (17)..(17): represents the anti-watson crick partner to position 10
gaaggaaggnuugguangugguauauuc

SEQ ID NO: 8 - RNA, 25 nt, Artificial Sequence
  generic consensus
  misc_feature (1)..(1): represnts G or C
  misc_feature (2)..(2): n is a, c, g, or u
  misc_feature (6)..(6): represnts R or D
  misc_feature (9)..(9): represnts A or U
  misc_feature (12)..(12): n is a, c, g, or u
  misc_feature (14)..(14): n is a, c, g, or u
  misc_feature (17)..(17): represnts A or N
  misc_feature (18)..(18): represnts A or U or D
  misc_feature (20)..(20): represnts A or N
  misc_feature (23)..(23): represnts A or C
  misc_feature (25)..(25): represnts A or D
nnrggnagnggngnggnngnggnrn

SEQ ID NO: 9 - RNA, 23 nt, Artificial sequence
  specific aptamers
ggaaggaauggaaugugguaaaa

SEQ ID NO: 10 - RNA, 23 nt, Artificial sequence
  specific aptamers
ggaaggaauggaaugugguaaca

SEQ ID NO: 11 - RNA, 23 nt, Artificial sequence
  specific aptamers
ggaaggaauggaaugugguaaga

SEQ ID NO: 12 - RNA, 23 nt, Artificial sequence
  specific aptamers
ggaaggaauggaaugugguaaua

SEQ ID NO: 13 - RNA, 22 nt, Artificial sequence
  specific aptamers
ggaaggaauggaaugugguaaa

SEQ ID NO: 14 - RNA, 23 nt, Artificial sequence
  specific aptamers
ggaaggaauggaaugugguacaa

SEQ ID NO: 15 - RNA, 23 nt, Artificial sequence
  specific aptamers
ggaaggaauggaaugugguacca

SEQ ID NO: 16 - RNA, 23 nt, Artificial sequence
  specific aptamers
ggaaggaauggaaugugguacga

SEQ ID NO: 17 - RNA, 23 nt, Artificial sequence
  specific aptamers
ggaaggaauggaaugugguacua

SEQ ID NO: 18 - RNA, 22 nt, Artificial sequence
  specific aptamers
ggaaggaauggaaugugguaca

SEQ ID NO: 19 - RNA, 23 nt, Artificial sequence
  specific aptamers
ggaaggaauggaaugugguagaa

SEQ ID NO: 20 - RNA, 23 nt, Artificial sequence
  specific aptamers
ggaaggaauggaaugugguagca

SEQ ID NO: 21 - RNA, 23 nt, Artificial sequence
  specific aptamers
ggaaggaauggaaugugguagga

SEQ ID NO: 22 - RNA, 23 nt, Artificial sequence
  specific aptamers
ggaaggaauggaaugugguagua

SEQ ID NO: 23 - RNA, 22 nt, Artificial sequence
  specific aptamers
ggaaggaauggaaugugguaga

SEQ ID NO: 24 - RNA, 23 nt, Artificial sequence
  specific aptamers
ggaaggaauggaaugugguauaa

SEQ ID NO: 25 - RNA, 23 nt, Artificial sequence
  specific aptamers
ggaaggaauggaaugugguauca

SEQ ID NO: 26 - RNA, 23 nt, Artificial sequence
  specific aptamers
ggaaggaauggaaugugguauga

SEQ ID NO: 27 - RNA, 23 nt, Artificial sequence
  specific aptamers
ggaaggaauggaaugugguauua

SEQ ID NO: 28 - RNA, 22 nt, Artificial sequence
  specific aptamers
ggaaggaauggaaugugguaua

SEQ ID NO: 29 - RNA, 23 nt, Artificial sequence
  specific aptamers
ggaaggaauggcaugugguaaaa

SEQ ID NO: 30 - RNA, 23 nt, Artificial sequence
  specific aptamers
ggaaggaauggcaugugguaaca

SEQ ID NO: 31 - RNA, 23 nt, Artificial sequence
  specific aptamers
ggaaggaauggcaugugguaaga

SEQ ID NO: 32 - RNA, 23 nt, Artificial sequence
  specific aptamers
ggaaggaauggcaugugguaaua

SEQ ID NO: 33 - RNA, 22 nt, Artificial sequence
  specific aptamers
ggaaggaauggcaugugguaaa

SEQ ID NO: 34 - RNA, 23 nt, Artificial sequence
  specific aptamers
ggaaggaauggcaugugguacaa

SEQ ID NO: 35 - RNA, 23 nt, Artificial sequence
  specific aptamers
ggaaggaauggcaugugguacca

SEQ ID NO: 36 - RNA, 23 nt, Artificial sequence
  specific aptamers
ggaaggaauggcaugugguacga

SEQ ID NO: 37 - RNA, 23 nt, Artificial sequence
  specific aptamers
ggaaggaauggcaugugguacua

SEQ ID NO: 38 - RNA, 22 nt, Artificial sequence
  specific aptamers
ggaaggaauggcaugugguaca

SEQ ID NO: 39 - RNA, 23 nt, Artificial sequence
  specific aptamers
ggaaggaauggcaugugguagaa

SEQ ID NO: 40 - RNA, 23 nt, Artificial sequence
  specific aptamers
ggaaggaauggcaugugguagca

SEQ ID NO: 41 - RNA, 23 nt, Artificial sequence
  specific aptamers
ggaaggaauggcaugugguagga

SEQ ID NO: 42 - RNA, 23 nt, Artificial sequence
  specific aptamers
ggaaggaauggcaugugguagua

SEQ ID NO: 43 - RNA, 22 nt, Artificial sequence
  specific aptamers
ggaaggaauggcaugugguaga

SEQ ID NO: 44 - RNA, 23 nt, Artificial sequence
  specific aptamers
ggaaggaauggcaugugguauaa

SEQ ID NO: 45 - RNA, 23 nt, Artificial sequence
  specific aptamers
ggaaggaauggcaugugguauca

SEQ ID NO: 46 - RNA, 23 nt, Artificial sequence
  specific aptamers
ggaaggaauggcaugugguauga

SEQ ID NO: 47 - RNA, 23 nt, Artificial sequence
  specific aptamers
ggaaggaauggcaugugguauua

SEQ ID NO: 48 - RNA, 22 nt, Artificial sequence
  specific aptamers
ggaaggaauggcaugugguaua

SEQ ID NO: 49 - RNA, 23 nt, Artificial sequence
  specific aptamers
ggaaggaaugguaugugguaaaa

SEQ ID NO: 50 - RNA, 23 nt, Artificial sequence
  specific aptamers
ggaaggaaugguaugugguaaca

SEQ ID NO: 51 - RNA, 23 nt, Artificial sequence
  specific aptamers
ggaaggaaugguaugugguaaga

SEQ ID NO: 52 - RNA, 23 nt, Artificial sequence
  specific aptamers
ggaaggaaugguaugugguaaua

SEQ ID NO: 53 - RNA, 22 nt, Artificial sequence
  specific aptamers
ggaaggaaugguaugugguaaa

SEQ ID NO: 54 - RNA, 23 nt, Artificial sequence
  specific aptamers
ggaaggaaugguaugugguacaa

SEQ ID NO: 55 - RNA, 23 nt, Artificial sequence
  specific aptamers
ggaaggaaugguaugugguacca

SEQ ID NO: 56 - RNA, 23 nt, Artificial sequence
  specific aptamers
ggaaggaaugguaugugguacga

SEQ ID NO: 57 - RNA, 23 nt, Artificial sequence
  specific aptamers
ggaaggaaugguaugugguacua

SEQ ID NO: 58 - RNA, 22 nt, Artificial sequence
  specific aptamers
ggaaggaaugguaugugguaca

SEQ ID NO: 59 - RNA, 23 nt, Artificial sequence
  specific aptamers
ggaaggaaugguaugugguagaa

SEQ ID NO: 60 - RNA, 23 nt, Artificial sequence
  specific aptamers
ggaaggaaugguaugugguagca

SEQ ID NO: 61 - RNA, 23 nt, Artificial sequence
  specific aptamers
ggaaggaaugguaugugguagga

SEQ ID NO: 62 - RNA, 23 nt, Artificial sequence
  specific aptamers
ggaaggaaugguaugugguagua

SEQ ID NO: 63 - RNA, 22 nt, Artificial sequence
  specific aptamers
ggaaggaaugguaugugguaga

SEQ ID NO: 64 - RNA, 23 nt, Artificial sequence
  specific aptamers
ggaaggaaugguaugugguauaa

SEQ ID NO: 65 - RNA, 23 nt, Artificial sequence
  specific aptamers
ggaaggaaugguaugugguauca

SEQ ID NO: 66 - RNA, 23 nt, Artificial sequence
  specific aptamers
ggaaggaaugguaugugguauga

SEQ ID NO: 67 - RNA, 23 nt, Artificial sequence
  specific aptamers
ggaaggaaugguaugugguauua

SEQ ID NO: 68 - RNA, 22 nt, Artificial sequence
  specific aptamers
ggaaggaaugguaugugguaua

SEQ ID NO: 69 - RNA, 23 nt, Artificial sequence
  specific aptamers
ggaaggauuggaaugugguaaaa

SEQ ID NO: 70 - RNA, 23 nt, Artificial sequence
  specific aptamers
ggaaggauuggaaugugguaaca

SEQ ID NO: 71 - RNA, 23 nt, Artificial sequence
  specific aptamers
ggaaggauuggaaugugguaaga

SEQ ID NO: 72 - RNA, 23 nt, Artificial sequence
  specific aptamers
ggaaggauuggaaugugguaaua

SEQ ID NO: 73 - RNA, 22 nt, Artificial sequence
  specific aptamers
ggaaggauuggaaugugguaaa

SEQ ID NO: 74 - RNA, 23 nt, Artificial sequence
  specific aptamers
ggaaggauuggaaugugguacaa

SEQ ID NO: 75 - RNA, 23 nt, Artificial sequence
  specific aptamers
ggaaggauuggaaugugguacca

SEQ ID NO: 76 - RNA, 23 nt, Artificial sequence
  specific aptamers
ggaaggauuggaaugugguacga

SEQ ID NO: 77 - RNA, 23 nt, Artificial sequence
  specific aptamers
ggaaggauuggaaugugguacua

SEQ ID NO: 78 - RNA, 22 nt, Artificial sequence
  specific aptamers
ggaaggauuggaaugugguaca

SEQ ID NO: 79 - RNA, 23 nt, Artificial sequence
  specific aptamers
ggaaggauuggaaugugguagaa

SEQ ID NO: 80 - RNA, 23 nt, Artificial sequence
  specific aptamers
ggaaggauuggaaugugguagca

SEQ ID NO: 81 - RNA, 23 nt, Artificial sequence
  specific aptamers
ggaaggauuggaaugugguagga

SEQ ID NO: 82 - RNA, 23 nt, Artificial sequence
  specific aptamers
ggaaggauuggaaugugguagua

SEQ ID NO: 83 - RNA, 22 nt, Artificial sequence
  specific aptamers
ggaaggauuggaaugugguaga

SEQ ID NO: 84 - RNA, 23 nt, Artificial sequence
  specific aptamers
ggaaggauuggaaugugguauaa

SEQ ID NO: 85 - RNA, 23 nt, Artificial sequence
  specific aptamers
ggaaggauuggaaugugguauca

SEQ ID NO: 86 - RNA, 23 nt, Artificial sequence
  specific aptamers
ggaaggauuggaaugugguauga

SEQ ID NO: 87 - RNA, 23 nt, Artificial sequence
  specific aptamers
ggaaggauuggaaugugguauua

SEQ ID NO: 88 - RNA, 22 nt, Artificial sequence
  specific aptamers
ggaaggauuggaaugugguaua

SEQ ID NO: 89 - RNA, 23 nt, Artificial sequence
  specific aptamers
ggaaggauuggcaugugguaaaa

SEQ ID NO: 90 - RNA, 23 nt, Artificial sequence
  specific aptamers
ggaaggauuggcaugugguaaca

SEQ ID NO: 91 - RNA, 23 nt, Artificial sequence
  specific aptamers
ggaaggauuggcaugugguaaga

SEQ ID NO: 92 - RNA, 23 nt, Artificial sequence
  specific aptamers
ggaaggauuggcaugugguaaua

SEQ ID NO: 93 - RNA, 22 nt, Artificial sequence
  specific aptamers
ggaaggauuggcaugugguaaa

SEQ ID NO: 94 - RNA, 23 nt, Artificial sequence
  specific aptamers
ggaaggauuggcaugugguacaa

SEQ ID NO: 95 - RNA, 23 nt, Artificial sequence
  specific aptamers
ggaaggauuggcaugugguacca

SEQ ID NO: 96 - RNA, 23 nt, Artificial sequence
  specific aptamers
ggaaggauuggcaugugguacga

SEQ ID NO: 97 - RNA, 23 nt, Artificial sequence
  specific aptamers
ggaaggauuggcaugugguacua

SEQ ID NO: 98 - RNA, 22 nt, Artificial sequence
  specific aptamers
ggaaggauuggcaugugguaca

SEQ ID NO: 99 - RNA, 23 nt, Artificial sequence
  specific aptamers
ggaaggauuggcaugugguagaa

SEQ ID NO: 100 - RNA, 23 nt, Artificial sequence
  specific aptamers
ggaaggauuggcaugugguagca

SEQ ID NO: 101 - RNA, 23 nt, Artificial sequence
  specific aptamers
ggaaggauuggcaugugguagga

SEQ ID NO: 102 - RNA, 23 nt, Artificial sequence
  specific aptamers
ggaaggauuggcaugugguagua

SEQ ID NO: 103 - RNA, 22 nt, Artificial sequence
  specific aptamers
ggaaggauuggcaugugguaga

SEQ ID NO: 104 - RNA, 23 nt, Artificial sequence
  specific aptamers
ggaaggauuggcaugugguauaa

SEQ ID NO: 105 - RNA, 23 nt, Artificial sequence
  specific aptamers
ggaaggauuggcaugugguauca

SEQ ID NO: 106 - RNA, 23 nt, Artificial sequence
  specific aptamers
ggaaggauuggcaugugguauga

SEQ ID NO: 107 - RNA, 23 nt, Artificial sequence
  specific aptamers
ggaaggauuggcaugugguauua

SEQ ID NO: 108 - RNA, 22 nt, Artificial sequence
  specific aptamers
ggaaggauuggcaugugguaua

SEQ ID NO: 109 - RNA, 23 nt, Artificial sequence
  specific aptamers
ggaaggauugguaugugguaaaa

SEQ ID NO: 110 - RNA, 23 nt, Artificial sequence
  specific aptamers
ggaaggauugguaugugguaaca

SEQ ID NO: 111 - RNA, 23 nt, Artificial sequence
  specific aptamers
ggaaggauugguaugugguaaga

SEQ ID NO: 112 - RNA, 23 nt, Artificial sequence
  specific aptamers
ggaaggauugguaugugguaaua

SEQ ID NO: 113 - RNA, 22 nt, Artificial sequence
  specific aptamers
ggaaggauugguaugugguaaa

SEQ ID NO: 114 - RNA, 23 nt, Artificial sequence
  specific aptamers
ggaaggauugguaugugguacaa

SEQ ID NO: 115 - RNA, 23 nt, Artificial sequence
  specific aptamers
ggaaggauugguaugugguacca

SEQ ID NO: 116 - RNA, 23 nt, Artificial sequence
  specific aptamers
ggaaggauugguaugugguacga

SEQ ID NO: 117 - RNA, 23 nt, Artificial sequence
  specific aptamers
ggaaggauugguaugugguacua

SEQ ID NO: 118 - RNA, 22 nt, Artificial sequence
  specific aptamers
ggaaggauugguaugugguaca

SEQ ID NO: 119 - RNA, 23 nt, Artificial sequence
  specific aptamers
ggaaggauugguaugugguagaa

SEQ ID NO: 120 - RNA, 23 nt, Artificial sequence
  specific aptamers
ggaaggauugguaugugguagca

SEQ ID NO: 121 - RNA, 23 nt, Artificial sequence
  specific aptamers
ggaaggauugguaugugguagga

SEQ ID NO: 122 - RNA, 23 nt, Artificial sequence
  specific aptamers
ggaaggauugguaugugguagua

SEQ ID NO: 123 - RNA, 22 nt, Artificial sequence
  specific aptamers
ggaaggauugguaugugguaga

SEQ ID NO: 124 - RNA, 23 nt, Artificial sequence
  specific aptamers
ggaaggauugguaugugguauaa

SEQ ID NO: 125 - RNA, 23 nt, Artificial sequence
  specific aptamers
ggaaggauugguaugugguauca

SEQ ID NO: 126 - RNA, 23 nt, Artificial sequence
  specific aptamers
ggaaggauugguaugugguauga

SEQ ID NO: 127 - RNA, 23 nt, Artificial sequence
  specific aptamers
ggaaggauugguaugugguauua

SEQ ID NO: 128 - RNA, 22 nt, Artificial sequence
  specific aptamers
ggaaggauugguaugugguaua

SEQ ID NO: 129 - RNA, 23 nt, Artificial sequence
  specific aptamers
gguaggaauggaaugugguaaaa

SEQ ID NO: 130 - RNA, 23 nt, Artificial sequence
  specific aptamers
gguaggaauggaaugugguaaca

SEQ ID NO: 131 - RNA, 23 nt, Artificial sequence
  specific aptamers
gguaggaauggaaugugguaaga

SEQ ID NO: 132 - RNA, 23 nt, Artificial sequence
  specific aptamers
gguaggaauggaaugugguaaua

SEQ ID NO: 133 - RNA, 22 nt, Artificial sequence
  specific aptamers
gguaggaauggaaugugguaaa

SEQ ID NO: 134 - RNA, 23 nt, Artificial sequence
  specific aptamers
gguaggaauggaaugugguacaa

SEQ ID NO: 135 - RNA, 23 nt, Artificial sequence
  specific aptamers
gguaggaauggaaugugguacca

SEQ ID NO: 136 - RNA, 23 nt, Artificial sequence
  specific aptamers
gguaggaauggaaugugguacga

SEQ ID NO: 137 - RNA, 23 nt, Artificial sequence
  specific aptamers
gguaggaauggaaugugguacua

SEQ ID NO: 138 - RNA, 22 nt, Artificial sequence
  specific aptamers
gguaggaauggaaugugguaca

SEQ ID NO: 139 - RNA, 23 nt, Artificial sequence
  specific aptamers
gguaggaauggaaugugguagaa

SEQ ID NO: 140 - RNA, 23 nt, Artificial sequence
  specific aptamers
gguaggaauggaaugugguagca

SEQ ID NO: 141 - RNA, 23 nt, Artificial sequence
  specific aptamers
gguaggaauggaaugugguagga

SEQ ID NO: 142 - RNA, 23 nt, Artificial sequence
  specific aptamers
gguaggaauggaaugugguagua

SEQ ID NO: 143 - RNA, 22 nt, Artificial sequence
  specific aptamers
gguaggaauggaaugugguaga

SEQ ID NO: 144 - RNA, 23 nt, Artificial sequence
  specific aptamers
gguaggaauggaaugugguauaa

SEQ ID NO: 145 - RNA, 23 nt, Artificial sequence
  specific aptamers
gguaggaauggaaugugguauca

SEQ ID NO: 146 - RNA, 23 nt, Artificial sequence
  specific aptamers
gguaggaauggaaugugguauga

SEQ ID NO: 147 - RNA, 23 nt, Artificial sequence
  specific aptamers
gguaggaauggaaugugguauua

SEQ ID NO: 148 - RNA, 22 nt, Artificial sequence
  specific aptamers
gguaggaauggaaugugguaua

SEQ ID NO: 149 - RNA, 23 nt, Artificial sequence
  specific aptamers
gguaggaauggcaugugguaaaa

SEQ ID NO: 150 - RNA, 23 nt, Artificial sequence
  specific aptamers
gguaggaauggcaugugguaaca

SEQ ID NO: 151 - RNA, 23 nt, Artificial sequence
  specific aptamers
gguaggaauggcaugugguaaga

SEQ ID NO: 152 - RNA, 23 nt, Artificial sequence
  specific aptamers
gguaggaauggcaugugguaaua

SEQ ID NO: 153 - RNA, 22 nt, Artificial sequence
  specific aptamers
gguaggaauggcaugugguaaa

SEQ ID NO: 154 - RNA, 23 nt, Artificial sequence
  specific aptamers
gguaggaauggcaugugguacaa

SEQ ID NO: 155 - RNA, 23 nt, Artificial sequence
  specific aptamers
gguaggaauggcaugugguacca

SEQ ID NO: 156 - RNA, 23 nt, Artificial sequence
  specific aptamers
gguaggaauggcaugugguacga

SEQ ID NO: 157 - RNA, 23 nt, Artificial sequence
  specific aptamers
gguaggaauggcaugugguacua

SEQ ID NO: 158 - RNA, 22 nt, Artificial sequence
  specific aptamers
gguaggaauggcaugugguaca

SEQ ID NO: 159 - RNA, 23 nt, Artificial sequence
  specific aptamers
gguaggaauggcaugugguagaa

SEQ ID NO: 160 - RNA, 23 nt, Artificial sequence
  specific aptamers
gguaggaauggcaugugguagca

SEQ ID NO: 161 - RNA, 23 nt, Artificial sequence
  specific aptamers
gguaggaauggcaugugguagga

SEQ ID NO: 162 - RNA, 23 nt, Artificial sequence
  specific aptamers
gguaggaauggcaugugguagua

SEQ ID NO: 163 - RNA, 22 nt, Artificial sequence
  specific aptamers
gguaggaauggcaugugguaga

SEQ ID NO: 164 - RNA, 23 nt, Artificial sequence
  specific aptamers
gguaggaauggcaugugguauaa

SEQ ID NO: 165 - RNA, 23 nt, Artificial sequence
  specific aptamers
gguaggaauggcaugugguauca

SEQ ID NO: 166 - RNA, 23 nt, Artificial sequence
  specific aptamers
gguaggaauggcaugugguauga

SEQ ID NO: 167 - RNA, 23 nt, Artificial sequence
  specific aptamers
gguaggaauggcaugugguauua

SEQ ID NO: 168 - RNA, 22 nt, Artificial sequence
  specific aptamers
gguaggaauggcaugugguaua

SEQ ID NO: 169 - RNA, 23 nt, Artificial sequence
  specific aptamers
gguaggaaugguaugugguaaaa

SEQ ID NO: 170 - RNA, 23 nt, Artificial sequence
  specific aptamers
gguaggaaugguaugugguaaca

SEQ ID NO: 171 - RNA, 23 nt, Artificial sequence
  specific aptamers
gguaggaaugguaugugguaaga

SEQ ID NO: 172 - RNA, 23 nt, Artificial sequence
  specific aptamers
gguaggaaugguaugugguaaua

SEQ ID NO: 173 - RNA, 22 nt, Artificial sequence
  specific aptamers
gguaggaaugguaugugguaaa

SEQ ID NO: 174 - RNA, 23 nt, Artificial sequence
  specific aptamers
gguaggaaugguaugugguacaa

SEQ ID NO: 175 - RNA, 23 nt, Artificial sequence
  specific aptamers
gguaggaaugguaugugguacca

SEQ ID NO: 176 - RNA, 23 nt, Artificial sequence
  specific aptamers
gguaggaaugguaugugguacga

SEQ ID NO: 177 - RNA, 23 nt, Artificial sequence
  specific aptamers
gguaggaaugguaugugguacua

SEQ ID NO: 178 - RNA, 22 nt, Artificial sequence
  specific aptamers
gguaggaaugguaugugguaca

SEQ ID NO: 179 - RNA, 23 nt, Artificial sequence
  specific aptamers
gguaggaaugguaugugguagaa

SEQ ID NO: 180 - RNA, 23 nt, Artificial sequence
  specific aptamers
gguaggaaugguaugugguagca

SEQ ID NO: 181 - RNA, 23 nt, Artificial sequence
  specific aptamers
gguaggaaugguaugugguagga

SEQ ID NO: 182 - RNA, 23 nt, Artificial sequence
  specific aptamers
gguaggaaugguaugugguagua

SEQ ID NO: 183 - RNA, 22 nt, Artificial sequence
  specific aptamers
gguaggaaugguaugugguaga

SEQ ID NO: 184 - RNA, 23 nt, Artificial sequence
  specific aptamers
gguaggaaugguaugugguauaa

SEQ ID NO: 185 - RNA, 23 nt, Artificial sequence
  specific aptamers
gguaggaaugguaugugguauca

SEQ ID NO: 186 - RNA, 23 nt, Artificial sequence
  specific aptamers
gguaggaaugguaugugguauga

SEQ ID NO: 187 - RNA, 23 nt, Artificial sequence
  specific aptamers
gguaggaaugguaugugguauua

SEQ ID NO: 188 - RNA, 22 nt, Artificial sequence
  specific aptamers
gguaggaaugguaugugguaua

SEQ ID NO: 189 - RNA, 23 nt, Artificial sequence
  specific aptamers
gguaggauuggaaugugguaaaa

SEQ ID NO: 190 - RNA, 23 nt, Artificial sequence
  specific aptamers
gguaggauuggaaugugguaaca

SEQ ID NO: 191 - RNA, 23 nt, Artificial sequence
  specific aptamers
gguaggauuggaaugugguaaga

SEQ ID NO: 192 - RNA, 23 nt, Artificial sequence
  specific aptamers
gguaggauuggaaugugguaaua

SEQ ID NO: 193 - RNA, 22 nt, Artificial sequence
  specific aptamers
gguaggauuggaaugugguaaa

SEQ ID NO: 194 - RNA, 23 nt, Artificial sequence
  specific aptamers
gguaggauuggaaugugguacaa

SEQ ID NO: 195 - RNA, 23 nt, Artificial sequence
  specific aptamers
gguaggauuggaaugugguacca

SEQ ID NO: 196 - RNA, 23 nt, Artificial sequence
  specific aptamers
gguaggauuggaaugugguacga

SEQ ID NO: 197 - RNA, 23 nt, Artificial sequence
  specific aptamers
gguaggauuggaaugugguacua

SEQ ID NO: 198 - RNA, 22 nt, Artificial sequence
  specific aptamers
gguaggauuggaaugugguaca

SEQ ID NO: 199 - RNA, 23 nt, Artificial sequence
  specific aptamers
gguaggauuggaaugugguagaa

SEQ ID NO: 200 - RNA, 23 nt, Artificial sequence
  specific aptamers
gguaggauuggaaugugguagca

SEQ ID NO: 201 - RNA, 23 nt, Artificial sequence
  specific aptamers
gguaggauuggaaugugguagga

SEQ ID NO: 202 - RNA, 23 nt, Artificial sequence
  specific aptamers
gguaggauuggaaugugguagua

SEQ ID NO: 203 - RNA, 22 nt, Artificial sequence
  specific aptamers
gguaggauuggaaugugguaga

SEQ ID NO: 204 - RNA, 23 nt, Artificial sequence
  specific aptamers
gguaggauuggaaugugguauaa

SEQ ID NO: 205 - RNA, 23 nt, Artificial sequence
  specific aptamers
gguaggauuggaaugugguauca

SEQ ID NO: 206 - RNA, 23 nt, Artificial sequence
  specific aptamers
gguaggauuggaaugugguauga

SEQ ID NO: 207 - RNA, 23 nt, Artificial sequence
  specific aptamers
gguaggauuggaaugugguauua

SEQ ID NO: 208 - RNA, 22 nt, Artificial sequence
  specific aptamers
gguaggauuggaaugugguaua

SEQ ID NO: 209 - RNA, 23 nt, Artificial sequence
  specific aptamers
gguaggauuggcaugugguaaaa

SEQ ID NO: 210 - RNA, 23 nt, Artificial sequence
  specific aptamers
gguaggauuggcaugugguaaca

SEQ ID NO: 211 - RNA, 23 nt, Artificial sequence
  specific aptamers
gguaggauuggcaugugguaaga

SEQ ID NO: 212 - RNA, 23 nt, Artificial sequence
  specific aptamers
gguaggauuggcaugugguaaua

SEQ ID NO: 213 - RNA, 22 nt, Artificial sequence
  specific aptamers
gguaggauuggcaugugguaaa

SEQ ID NO: 214 - RNA, 23 nt, Artificial sequence
  specific aptamers
gguaggauuggcaugugguacaa

SEQ ID NO: 215 - RNA, 23 nt, Artificial sequence
  specific aptamers
gguaggauuggcaugugguacca

SEQ ID NO: 216 - RNA, 23 nt, Artificial sequence
  specific aptamers
gguaggauuggcaugugguacga

SEQ ID NO: 217 - RNA, 23 nt, Artificial sequence
  specific aptamers
gguaggauuggcaugugguacua

SEQ ID NO: 218 - RNA, 22 nt, Artificial sequence
  specific aptamers
gguaggauuggcaugugguaca

SEQ ID NO: 219 - RNA, 23 nt, Artificial sequence
  specific aptamers
gguaggauuggcaugugguagaa

SEQ ID NO: 220 - RNA, 23 nt, Artificial sequence
  specific aptamers
gguaggauuggcaugugguagca

SEQ ID NO: 221 - RNA, 23 nt, Artificial sequence
  specific aptamers
gguaggauuggcaugugguagga

SEQ ID NO: 222 - RNA, 23 nt, Artificial sequence
  specific aptamers
gguaggauuggcaugugguagua

SEQ ID NO: 223 - RNA, 22 nt, Artificial sequence
  specific aptamers
gguaggauuggcaugugguaga

SEQ ID NO: 224 - RNA, 23 nt, Artificial sequence
  specific aptamers
gguaggauuggcaugugguauaa

SEQ ID NO: 225 - RNA, 23 nt, Artificial sequence
  specific aptamers
gguaggauuggcaugugguauca

SEQ ID NO: 226 - RNA, 23 nt, Artificial sequence
  specific aptamers
gguaggauuggcaugugguauga

SEQ ID NO: 227 - RNA, 23 nt, Artificial sequence
  specific aptamers
gguaggauuggcaugugguauua

SEQ ID NO: 228 - RNA, 22 nt, Artificial sequence
  specific aptamers
gguaggauuggcaugugguaua

SEQ ID NO: 229 - RNA, 23 nt, Artificial sequence
  specific aptamers
gguaggauugguaugugguaaaa

SEQ ID NO: 230 - RNA, 23 nt, Artificial sequence
  specific aptamers
gguaggauugguaugugguaaca

SEQ ID NO: 231 - RNA, 23 nt, Artificial sequence
  specific aptamers
gguaggauugguaugugguaaga

SEQ ID NO: 232 - RNA, 23 nt, Artificial sequence
  specific aptamers
gguaggauugguaugugguaaua

SEQ ID NO: 233 - RNA, 22 nt, Artificial sequence
  specific aptamers
gguaggauugguaugugguaaa

SEQ ID NO: 234 - RNA, 23 nt, Artificial sequence
  specific aptamers
gguaggauugguaugugguacaa

SEQ ID NO: 235 - RNA, 23 nt, Artificial sequence
  specific aptamers
gguaggauugguaugugguacca

SEQ ID NO: 236 - RNA, 23 nt, Artificial sequence
  specific aptamers
gguaggauugguaugugguacga

SEQ ID NO: 237 - RNA, 23 nt, Artificial sequence
  specific aptamers
gguaggauugguaugugguacua

SEQ ID NO: 238 - RNA, 22 nt, Artificial sequence
  specific aptamers
gguaggauugguaugugguaca

SEQ ID NO: 239 - RNA, 23 nt, Artificial sequence
  specific aptamers
gguaggauugguaugugguagaa

SEQ ID NO: 240 - RNA, 23 nt, Artificial sequence
  specific aptamers
gguaggauugguaugugguagca

SEQ ID NO: 241 - RNA, 23 nt, Artificial sequence
  specific aptamers
gguaggauugguaugugguagga

SEQ ID NO: 242 - RNA, 23 nt, Artificial sequence
  specific aptamers
gguaggauugguaugugguagua

SEQ ID NO: 243 - RNA, 22 nt, Artificial sequence
  specific aptamers
gguaggauugguaugugguaga

SEQ ID NO: 244 - RNA, 23 nt, Artificial sequence
  specific aptamers
gguaggauugguaugugguauaa

SEQ ID NO: 245 - RNA, 23 nt, Artificial sequence
  specific aptamers
gguaggauugguaugugguauca

SEQ ID NO: 246 - RNA, 23 nt, Artificial sequence
  specific aptamers
gguaggauugguaugugguauga

SEQ ID NO: 247 - RNA, 23 nt, Artificial sequence
  specific aptamers
gguaggauugguaugugguauua

SEQ ID NO: 248 - RNA, 22 nt, Artificial sequence
  specific aptamers
gguaggauugguaugugguaua

SEQ ID NO: 249 - RNA, 23 nt, Artificial sequence
  specific aptamers
ggaaggaauggaaugugguaaau

SEQ ID NO: 250 - RNA, 23 nt, Artificial sequence
  specific aptamers
ggaaggaauggaaugugguaacu

SEQ ID NO: 251 - RNA, 23 nt, Artificial sequence
  specific aptamers
ggaaggaauggaaugugguaagu

SEQ ID NO: 252 - RNA, 23 nt, Artificial sequence
  specific aptamers
ggaaggaauggaaugugguaauu

SEQ ID NO: 253 - RNA, 22 nt, Artificial sequence
  specific aptamers
ggaaggaauggaaugugguaau

SEQ ID NO: 254 - RNA, 23 nt, Artificial sequence
  specific aptamers
ggaaggaauggaaugugguacau

SEQ ID NO: 255 - RNA, 23 nt, Artificial sequence
  specific aptamers
ggaaggaauggaaugugguaccu

SEQ ID NO: 256 - RNA, 23 nt, Artificial sequence
  specific aptamers
ggaaggaauggaaugugguacgu

SEQ ID NO: 257 - RNA, 23 nt, Artificial sequence
  specific aptamers
ggaaggaauggaaugugguacuu

SEQ ID NO: 258 - RNA, 22 nt, Artificial sequence
  specific aptamers
ggaaggaauggaaugugguacu

SEQ ID NO: 259 - RNA, 23 nt, Artificial sequence
  specific aptamers
ggaaggaauggaaugugguagau

SEQ ID NO: 260 - RNA, 23 nt, Artificial sequence
  specific aptamers
ggaaggaauggaaugugguagcu

SEQ ID NO: 261 - RNA, 23 nt, Artificial sequence
  specific aptamers
ggaaggaauggaaugugguaggu

SEQ ID NO: 262 - RNA, 23 nt, Artificial sequence
  specific aptamers
ggaaggaauggaaugugguaguu

SEQ ID NO: 263 - RNA, 22 nt, Artificial sequence
  specific aptamers
ggaaggaauggaaugugguagu

SEQ ID NO: 264 - RNA, 23 nt, Artificial sequence
  specific aptamers
ggaaggaauggaaugugguauau

SEQ ID NO: 265 - RNA, 23 nt, Artificial sequence
  specific aptamers
ggaaggaauggaaugugguaucu

SEQ ID NO: 266 - RNA, 23 nt, Artificial sequence
  specific aptamers
ggaaggaauggaaugugguaugu

SEQ ID NO: 267 - RNA, 23 nt, Artificial sequence
  specific aptamers
ggaaggaauggaaugugguauuu

SEQ ID NO: 268 - RNA, 22 nt, Artificial sequence
  specific aptamers
ggaaggaauggaaugugguauu

SEQ ID NO: 269 - RNA, 23 nt, Artificial sequence
  specific aptamers
ggaaggaauggcaugugguaaau

SEQ ID NO: 270 - RNA, 23 nt, Artificial sequence
  specific aptamers
ggaaggaauggcaugugguaacu

SEQ ID NO: 271 - RNA, 23 nt, Artificial sequence
  specific aptamers
ggaaggaauggcaugugguaagu

SEQ ID NO: 272 - RNA, 23 nt, Artificial sequence
  specific aptamers
ggaaggaauggcaugugguaauu

SEQ ID NO: 273 - RNA, 22 nt, Artificial sequence
  specific aptamers
ggaaggaauggcaugugguaau

SEQ ID NO: 274 - RNA, 23 nt, Artificial sequence
  specific aptamers
ggaaggaauggcaugugguacau

SEQ ID NO: 275 - RNA, 23 nt, Artificial sequence
  specific aptamers
ggaaggaauggcaugugguaccu

SEQ ID NO: 276 - RNA, 23 nt, Artificial sequence
  specific aptamers
ggaaggaauggcaugugguacgu

SEQ ID NO: 277 - RNA, 23 nt, Artificial sequence
  specific aptamers
ggaaggaauggcaugugguacuu

SEQ ID NO: 278 - RNA, 22 nt, Artificial sequence
  specific aptamers
ggaaggaauggcaugugguacu

SEQ ID NO: 279 - RNA, 23 nt, Artificial sequence
  specific aptamers
ggaaggaauggcaugugguagau

SEQ ID NO: 280 - RNA, 23 nt, Artificial sequence
  specific aptamers
ggaaggaauggcaugugguagcu

SEQ ID NO: 281 - RNA, 23 nt, Artificial sequence
  specific aptamers
ggaaggaauggcaugugguaggu

SEQ ID NO: 282 - RNA, 23 nt, Artificial sequence
  specific aptamers
ggaaggaauggcaugugguaguu

SEQ ID NO: 283 - RNA, 22 nt, Artificial sequence
  specific aptamers
ggaaggaauggcaugugguagu

SEQ ID NO: 284 - RNA, 23 nt, Artificial sequence
  specific aptamers
ggaaggaauggcaugugguauau

SEQ ID NO: 285 - RNA, 23 nt, Artificial sequence
  specific aptamers
ggaaggaauggcaugugguaucu

SEQ ID NO: 286 - RNA, 23 nt, Artificial sequence
  specific aptamers
ggaaggaauggcaugugguaugu

SEQ ID NO: 287 - RNA, 23 nt, Artificial sequence
  specific aptamers
ggaaggaauggcaugugguauuu

SEQ ID NO: 288 - RNA, 22 nt, Artificial sequence
  specific aptamers
ggaaggaauggcaugugguauu

SEQ ID NO: 289 - RNA, 23 nt, Artificial sequence
  specific aptamers
ggaaggaaugguaugugguaaau

SEQ ID NO: 290 - RNA, 23 nt, Artificial sequence
  specific aptamers
ggaaggaaugguaugugguaacu

SEQ ID NO: 291 - RNA, 23 nt, Artificial sequence
  specific aptamers
ggaaggaaugguaugugguaagu

SEQ ID NO: 292 - RNA, 23 nt, Artificial sequence
  specific aptamers
ggaaggaaugguaugugguaauu

SEQ ID NO: 293 - RNA, 22 nt, Artificial sequence
  specific aptamers
ggaaggaaugguaugugguaau

SEQ ID NO: 294 - RNA, 23 nt, Artificial sequence
  specific aptamers
ggaaggaaugguaugugguacau

SEQ ID NO: 295 - RNA, 23 nt, Artificial sequence
  specific aptamers
ggaaggaaugguaugugguaccu

SEQ ID NO: 296 - RNA, 23 nt, Artificial sequence
  specific aptamers
ggaaggaaugguaugugguacgu

SEQ ID NO: 297 - RNA, 23 nt, Artificial sequence
  specific aptamers
ggaaggaaugguaugugguacuu

SEQ ID NO: 298 - RNA, 22 nt, Artificial sequence
  specific aptamers
ggaaggaaugguaugugguacu

SEQ ID NO: 299 - RNA, 23 nt, Artificial sequence
  specific aptamers
ggaaggaaugguaugugguagau

SEQ ID NO: 300 - RNA, 23 nt, Artificial sequence
  specific aptamers
ggaaggaaugguaugugguagcu

SEQ ID NO: 301 - RNA, 23 nt, Artificial sequence
  specific aptamers
ggaaggaaugguaugugguaggu

SEQ ID NO: 302 - RNA, 23 nt, Artificial sequence
  specific aptamers
ggaaggaaugguaugugguaguu

SEQ ID NO: 303 - RNA, 22 nt, Artificial sequence
  specific aptamers
ggaaggaaugguaugugguagu

SEQ ID NO: 304 - RNA, 23 nt, Artificial sequence
  specific aptamers
ggaaggaaugguaugugguauau

SEQ ID NO: 305 - RNA, 23 nt, Artificial sequence
  specific aptamers
ggaaggaaugguaugugguaucu

SEQ ID NO: 306 - RNA, 23 nt, Artificial sequence
  specific aptamers
ggaaggaaugguaugugguaugu

SEQ ID NO: 307 - RNA, 23 nt, Artificial sequence
  specific aptamers
ggaaggaaugguaugugguauuu

SEQ ID NO: 308 - RNA, 22 nt, Artificial sequence
  specific aptamers
ggaaggaaugguaugugguauu

SEQ ID NO: 309 - RNA, 23 nt, Artificial sequence
  specific aptamers
ggaaggauuggaaugugguaaau

SEQ ID NO: 310 - RNA, 23 nt, Artificial sequence
  specific aptamers
ggaaggauuggaaugugguaacu

SEQ ID NO: 311 - RNA, 23 nt, Artificial sequence
  specific aptamers
ggaaggauuggaaugugguaagu

SEQ ID NO: 312 - RNA, 23 nt, Artificial sequence
  specific aptamers
ggaaggauuggaaugugguaauu

SEQ ID NO: 313 - RNA, 22 nt, Artificial sequence
  specific aptamers
ggaaggauuggaaugugguaau

SEQ ID NO: 314 - RNA, 23 nt, Artificial sequence
  specific aptamers
ggaaggauuggaaugugguacau

SEQ ID NO: 315 - RNA, 23 nt, Artificial sequence
  specific aptamers
ggaaggauuggaaugugguaccu

SEQ ID NO: 316 - RNA, 23 nt, Artificial sequence
  specific aptamers
ggaaggauuggaaugugguacgu

SEQ ID NO: 317 - RNA, 23 nt, Artificial sequence
  specific aptamers
ggaaggauuggaaugugguacuu

SEQ ID NO: 318 - RNA, 22 nt, Artificial sequence
  specific aptamers
ggaaggauuggaaugugguacu

SEQ ID NO: 319 - RNA, 23 nt, Artificial sequence
  specific aptamers
ggaaggauuggaaugugguagau

SEQ ID NO: 320 - RNA, 23 nt, Artificial sequence
  specific aptamers
ggaaggauuggaaugugguagcu

SEQ ID NO: 321 - RNA, 23 nt, Artificial sequence
  specific aptamers
ggaaggauuggaaugugguaggu

SEQ ID NO: 322 - RNA, 23 nt, Artificial sequence
  specific aptamers
ggaaggauuggaaugugguaguu

SEQ ID NO: 323 - RNA, 22 nt, Artificial sequence
  specific aptamers
ggaaggauuggaaugugguagu

SEQ ID NO: 324 - RNA, 23 nt, Artificial sequence
  specific aptamers
ggaaggauuggaaugugguauau

SEQ ID NO: 325 - RNA, 23 nt, Artificial sequence
  specific aptamers
ggaaggauuggaaugugguaucu

SEQ ID NO: 326 - RNA, 23 nt, Artificial sequence
  specific aptamers
ggaaggauuggaaugugguaugu

SEQ ID NO: 327 - RNA, 23 nt, Artificial sequence
  specific aptamers
ggaaggauuggaaugugguauuu

SEQ ID NO: 328 - RNA, 22 nt, Artificial sequence
  specific aptamers
ggaaggauuggaaugugguauu

SEQ ID NO: 329 - RNA, 23 nt, Artificial sequence
  specific aptamers
ggaaggauuggcaugugguaaau

SEQ ID NO: 330 - RNA, 23 nt, Artificial sequence
  specific aptamers
ggaaggauuggcaugugguaacu

SEQ ID NO: 331 - RNA, 23 nt, Artificial sequence
  specific aptamers
ggaaggauuggcaugugguaagu

SEQ ID NO: 332 - RNA, 23 nt, Artificial sequence
  specific aptamers
ggaaggauuggcaugugguaauu

SEQ ID NO: 333 - RNA, 22 nt, Artificial sequence
  specific aptamers
ggaaggauuggcaugugguaau

SEQ ID NO: 334 - RNA, 23 nt, Artificial sequence
  specific aptamers
ggaaggauuggcaugugguacau

SEQ ID NO: 335 - RNA, 23 nt, Artificial sequence
  specific aptamers
ggaaggauuggcaugugguaccu

SEQ ID NO: 336 - RNA, 23 nt, Artificial sequence
  specific aptamers
ggaaggauuggcaugugguacgu

SEQ ID NO: 337 - RNA, 23 nt, Artificial sequence
  specific aptamers
ggaaggauuggcaugugguacuu

SEQ ID NO: 338 - RNA, 22 nt, Artificial sequence
  specific aptamers
ggaaggauuggcaugugguacu

SEQ ID NO: 339 - RNA, 23 nt, Artificial sequence
  specific aptamers
ggaaggauuggcaugugguagau

SEQ ID NO: 340 - RNA, 23 nt, Artificial sequence
  specific aptamers
ggaaggauuggcaugugguagcu

SEQ ID NO: 341 - RNA, 23 nt, Artificial sequence
  specific aptamers
ggaaggauuggcaugugguaggu

SEQ ID NO: 342 - RNA, 23 nt, Artificial sequence
  specific aptamers
ggaaggauuggcaugugguaguu

SEQ ID NO: 343 - RNA, 22 nt, Artificial sequence
  specific aptamers
ggaaggauuggcaugugguagu

SEQ ID NO: 344 - RNA, 23 nt, Artificial sequence
  specific aptamers
ggaaggauuggcaugugguauau

SEQ ID NO: 345 - RNA, 23 nt, Artificial sequence
  specific aptamers
ggaaggauuggcaugugguaucu

SEQ ID NO: 346 - RNA, 23 nt, Artificial sequence
  specific aptamers
ggaaggauuggcaugugguaugu

SEQ ID NO: 347 - RNA, 23 nt, Artificial sequence
  specific aptamers
ggaaggauuggcaugugguauuu

SEQ ID NO: 348 - RNA, 22 nt, Artificial sequence
  specific aptamers
ggaaggauuggcaugugguauu

SEQ ID NO: 349 - RNA, 23 nt, Artificial sequence
  specific aptamers
ggaaggauugguaugugguaaau

SEQ ID NO: 350 - RNA, 23 nt, Artificial sequence
  specific aptamers
ggaaggauugguaugugguaacu

SEQ ID NO: 351 - RNA, 23 nt, Artificial sequence
  specific aptamers
ggaaggauugguaugugguaagu

SEQ ID NO: 352 - RNA, 23 nt, Artificial sequence
  specific aptamers
ggaaggauugguaugugguaauu

SEQ ID NO: 353 - RNA, 22 nt, Artificial sequence
  specific aptamers
ggaaggauugguaugugguaau

SEQ ID NO: 354 - RNA, 23 nt, Artificial sequence
  specific aptamers
ggaaggauugguaugugguacau

SEQ ID NO: 355 - RNA, 23 nt, Artificial sequence
  specific aptamers
ggaaggauugguaugugguaccu

SEQ ID NO: 356 - RNA, 23 nt, Artificial sequence
  specific aptamers
ggaaggauugguaugugguacgu

SEQ ID NO: 357 - RNA, 23 nt, Artificial sequence
  specific aptamers
ggaaggauugguaugugguacuu

SEQ ID NO: 358 - RNA, 22 nt, Artificial sequence
  specific aptamers
ggaaggauugguaugugguacu

SEQ ID NO: 359 - RNA, 23 nt, Artificial sequence
  specific aptamers
ggaaggauugguaugugguagau

SEQ ID NO: 360 - RNA, 23 nt, Artificial sequence
  specific aptamers
ggaaggauugguaugugguagcu

SEQ ID NO: 361 - RNA, 23 nt, Artificial sequence
  specific aptamers
ggaaggauugguaugugguaggu

SEQ ID NO: 362 - RNA, 23 nt, Artificial sequence
  specific aptamers
ggaaggauugguaugugguaguu

SEQ ID NO: 363 - RNA, 22 nt, Artificial sequence
  specific aptamers
ggaaggauugguaugugguagu

SEQ ID NO: 364 - RNA, 23 nt, Artificial sequence
  specific aptamers
ggaaggauugguaugugguauau

SEQ ID NO: 365 - RNA, 23 nt, Artificial sequence
  specific aptamers
ggaaggauugguaugugguaucu

SEQ ID NO: 366 - RNA, 23 nt, Artificial sequence
  specific aptamers
ggaaggauugguaugugguaugu

SEQ ID NO: 367 - RNA, 23 nt, Artificial sequence
  specific aptamers
ggaaggauugguaugugguauuu

SEQ ID NO: 368 - RNA, 22 nt, Artificial sequence
  specific aptamers
ggaaggauugguaugugguauu

SEQ ID NO: 369 - RNA, 23 nt, Artificial sequence
  specific aptamers
gguaggaauggaaugugguaaau

SEQ ID NO: 370 - RNA, 23 nt, Artificial sequence
  specific aptamers
gguaggaauggaaugugguaacu

SEQ ID NO: 371 - RNA, 23 nt, Artificial sequence
  specific aptamers
gguaggaauggaaugugguaagu

SEQ ID NO: 372 - RNA, 23 nt, Artificial sequence
  specific aptamers
gguaggaauggaaugugguaauu

SEQ ID NO: 373 - RNA, 22 nt, Artificial sequence
  specific aptamers
gguaggaauggaaugugguaau

SEQ ID NO: 374 - RNA, 23 nt, Artificial sequence
  specific aptamers
gguaggaauggaaugugguacau

SEQ ID NO: 375 - RNA, 23 nt, Artificial sequence
  specific aptamers
gguaggaauggaaugugguaccu

SEQ ID NO: 376 - RNA, 23 nt, Artificial sequence
  specific aptamers
gguaggaauggaaugugguacgu

SEQ ID NO: 377 - RNA, 23 nt, Artificial sequence
  specific aptamers
gguaggaauggaaugugguacuu

SEQ ID NO: 378 - RNA, 22 nt, Artificial sequence
  specific aptamers
gguaggaauggaaugugguacu

SEQ ID NO: 379 - RNA, 23 nt, Artificial sequence
  specific aptamers
gguaggaauggaaugugguagau

SEQ ID NO: 380 - RNA, 23 nt, Artificial sequence
  specific aptamers
gguaggaauggaaugugguagcu

SEQ ID NO: 381 - RNA, 23 nt, Artificial sequence
  specific aptamers
gguaggaauggaaugugguaggu

SEQ ID NO: 382 - RNA, 23 nt, Artificial sequence
  specific aptamers
gguaggaauggaaugugguaguu

SEQ ID NO: 383 - RNA, 22 nt, Artificial sequence
  specific aptamers
gguaggaauggaaugugguagu

SEQ ID NO: 384 - RNA, 23 nt, Artificial sequence
  specific aptamers
gguaggaauggaaugugguauau

SEQ ID NO: 385 - RNA, 23 nt, Artificial sequence
  specific aptamers
gguaggaauggaaugugguaucu

SEQ ID NO: 386 - RNA, 23 nt, Artificial sequence
  specific aptamers
gguaggaauggaaugugguaugu

SEQ ID NO: 387 - RNA, 23 nt, Artificial sequence
  specific aptamers
gguaggaauggaaugugguauuu

SEQ ID NO: 388 - RNA, 22 nt, Artificial sequence
  specific aptamers
gguaggaauggaaugugguauu

SEQ ID NO: 389 - RNA, 23 nt, Artificial sequence
  specific aptamers
gguaggaauggcaugugguaaau

SEQ ID NO: 390 - RNA, 23 nt, Artificial sequence
  specific aptamers
gguaggaauggcaugugguaacu

SEQ ID NO: 391 - RNA, 23 nt, Artificial sequence
  specific aptamers
gguaggaauggcaugugguaagu

SEQ ID NO: 392 - RNA, 23 nt, Artificial sequence
  specific aptamers
gguaggaauggcaugugguaauu

SEQ ID NO: 393 - RNA, 22 nt, Artificial sequence
  specific aptamers
gguaggaauggcaugugguaau

SEQ ID NO: 394 - RNA, 23 nt, Artificial sequence
  specific aptamers
gguaggaauggcaugugguacau

SEQ ID NO: 395 - RNA, 23 nt, Artificial sequence
  specific aptamers
gguaggaauggcaugugguaccu

SEQ ID NO: 396 - RNA, 23 nt, Artificial sequence
  specific aptamers
gguaggaauggcaugugguacgu

SEQ ID NO: 397 - RNA, 23 nt, Artificial sequence
  specific aptamers
gguaggaauggcaugugguacuu

SEQ ID NO: 398 - RNA, 22 nt, Artificial sequence
  specific aptamers
gguaggaauggcaugugguacu

SEQ ID NO: 399 - RNA, 23 nt, Artificial sequence
  specific aptamers
gguaggaauggcaugugguagau

SEQ ID NO: 400 - RNA, 23 nt, Artificial sequence
  specific aptamers
gguaggaauggcaugugguagcu

SEQ ID NO: 401 - RNA, 23 nt, Artificial sequence
  specific aptamers
gguaggaauggcaugugguaggu

SEQ ID NO: 402 - RNA, 23 nt, Artificial sequence
  specific aptamers
gguaggaauggcaugugguaguu

SEQ ID NO: 403 - RNA, 22 nt, Artificial sequence
  specific aptamers
gguaggaauggcaugugguagu

SEQ ID NO: 404 - RNA, 23 nt, Artificial sequence
  specific aptamers
gguaggaauggcaugugguauau

SEQ ID NO: 405 - RNA, 23 nt, Artificial sequence
  specific aptamers
gguaggaauggcaugugguaucu

SEQ ID NO: 406 - RNA, 23 nt, Artificial sequence
  specific aptamers
gguaggaauggcaugugguaugu

SEQ ID NO: 407 - RNA, 23 nt, Artificial sequence
  specific aptamers
gguaggaauggcaugugguauuu

SEQ ID NO: 408 - RNA, 22 nt, Artificial sequence
  specific aptamers
gguaggaauggcaugugguauu

SEQ ID NO: 409 - RNA, 23 nt, Artificial sequence
  specific aptamers
gguaggaaugguaugugguaaau

SEQ ID NO: 410 - RNA, 23 nt, Artificial sequence
  specific aptamers
gguaggaaugguaugugguaacu

SEQ ID NO: 411 - RNA, 23 nt, Artificial sequence
  specific aptamers
gguaggaaugguaugugguaagu

SEQ ID NO: 412 - RNA, 23 nt, Artificial sequence
  specific aptamers
gguaggaaugguaugugguaauu

SEQ ID NO: 413 - RNA, 22 nt, Artificial sequence
  specific aptamers
gguaggaaugguaugugguaau

SEQ ID NO: 414 - RNA, 23 nt, Artificial sequence
  specific aptamers
gguaggaaugguaugugguacau

SEQ ID NO: 415 - RNA, 23 nt, Artificial sequence
  specific aptamers
gguaggaaugguaugugguaccu

SEQ ID NO: 416 - RNA, 23 nt, Artificial sequence
  specific aptamers
gguaggaaugguaugugguacgu

SEQ ID NO: 417 - RNA, 23 nt, Artificial sequence
  specific aptamers
gguaggaaugguaugugguacuu

SEQ ID NO: 418 - RNA, 22 nt, Artificial sequence
  specific aptamers
gguaggaaugguaugugguacu

SEQ ID NO: 419 - RNA, 23 nt, Artificial sequence
  specific aptamers
gguaggaaugguaugugguagau

SEQ ID NO: 420 - RNA, 23 nt, Artificial sequence
  specific aptamers
gguaggaaugguaugugguagcu

SEQ ID NO: 421 - RNA, 23 nt, Artificial sequence
  specific aptamers
gguaggaaugguaugugguaggu

SEQ ID NO: 422 - RNA, 23 nt, Artificial sequence
  specific aptamers
gguaggaaugguaugugguaguu

SEQ ID NO: 423 - RNA, 22 nt, Artificial sequence
  specific aptamers
gguaggaaugguaugugguagu

SEQ ID NO: 424 - RNA, 23 nt, Artificial sequence
  specific aptamers
gguaggaaugguaugugguauau

SEQ ID NO: 425 - RNA, 23 nt, Artificial sequence
  specific aptamers
gguaggaaugguaugugguaucu

SEQ ID NO: 426 - RNA, 23 nt, Artificial sequence
  specific aptamers
gguaggaaugguaugugguaugu

SEQ ID NO: 427 - RNA, 23 nt, Artificial sequence
  specific aptamers
gguaggaaugguaugugguauuu

SEQ ID NO: 428 - RNA, 22 nt, Artificial sequence
  specific aptamers
gguaggaaugguaugugguauu

SEQ ID NO: 429 - RNA, 23 nt, Artificial sequence
  specific aptamers
gguaggauuggaaugugguaaau

SEQ ID NO: 430 - RNA, 23 nt, Artificial sequence
  specific aptamers
gguaggauuggaaugugguaacu

SEQ ID NO: 431 - RNA, 23 nt, Artificial sequence
  specific aptamers
gguaggauuggaaugugguaagu

SEQ ID NO: 432 - RNA, 23 nt, Artificial sequence
  specific aptamers
gguaggauuggaaugugguaauu

SEQ ID NO: 433 - RNA, 22 nt, Artificial sequence
  specific aptamers
gguaggauuggaaugugguaau

SEQ ID NO: 434 - RNA, 23 nt, Artificial sequence
  specific aptamers
gguaggauuggaaugugguacau

SEQ ID NO: 435 - RNA, 23 nt, Artificial sequence
  specific aptamers
gguaggauuggaaugugguaccu

SEQ ID NO: 436 - RNA, 23 nt, Artificial sequence
  specific aptamers
gguaggauuggaaugugguacgu

SEQ ID NO: 437 - RNA, 23 nt, Artificial sequence
  specific aptamers
gguaggauuggaaugugguacuu

SEQ ID NO: 438 - RNA, 22 nt, Artificial sequence
  specific aptamers
gguaggauuggaaugugguacu

SEQ ID NO: 439 - RNA, 23 nt, Artificial sequence
  specific aptamers
gguaggauuggaaugugguagau

SEQ ID NO: 440 - RNA, 23 nt, Artificial sequence
  specific aptamers
gguaggauuggaaugugguagcu

SEQ ID NO: 441 - RNA, 23 nt, Artificial sequence
  specific aptamers
gguaggauuggaaugugguaggu

SEQ ID NO: 442 - RNA, 23 nt, Artificial sequence
  specific aptamers
gguaggauuggaaugugguaguu

SEQ ID NO: 443 - RNA, 22 nt, Artificial sequence
  specific aptamers
gguaggauuggaaugugguagu

SEQ ID NO: 444 - RNA, 23 nt, Artificial sequence
  specific aptamers
gguaggauuggaaugugguauau

SEQ ID NO: 445 - RNA, 23 nt, Artificial sequence
  specific aptamers
gguaggauuggaaugugguaucu

SEQ ID NO: 446 - RNA, 23 nt, Artificial sequence
  specific aptamers
gguaggauuggaaugugguaugu

SEQ ID NO: 447 - RNA, 23 nt, Artificial sequence
  specific aptamers
gguaggauuggaaugugguauuu

SEQ ID NO: 448 - RNA, 22 nt, Artificial sequence
  specific aptamers
gguaggauuggaaugugguauu

SEQ ID NO: 449 - RNA, 23 nt, Artificial sequence
  specific aptamers
gguaggauuggcaugugguaaau

SEQ ID NO: 450 - RNA, 23 nt, Artificial sequence
  specific aptamers
gguaggauuggcaugugguaacu

SEQ ID NO: 451 - RNA, 23 nt, Artificial sequence
  specific aptamers
gguaggauuggcaugugguaagu

SEQ ID NO: 452 - RNA, 23 nt, Artificial sequence
  specific aptamers
gguaggauuggcaugugguaauu

SEQ ID NO: 453 - RNA, 22 nt, Artificial sequence
  specific aptamers
gguaggauuggcaugugguaau

SEQ ID NO: 454 - RNA, 23 nt, Artificial sequence
  specific aptamers
gguaggauuggcaugugguacau

SEQ ID NO: 455 - RNA, 23 nt, Artificial sequence
  specific aptamers
gguaggauuggcaugugguaccu

SEQ ID NO: 456 - RNA, 23 nt, Artificial sequence
  specific aptamers
gguaggauuggcaugugguacgu

SEQ ID NO: 457 - RNA, 23 nt, Artificial sequence
  specific aptamers
gguaggauuggcaugugguacuu

SEQ ID NO: 458 - RNA, 22 nt, Artificial sequence
  specific aptamers
gguaggauuggcaugugguacu

SEQ ID NO: 459 - RNA, 23 nt, Artificial sequence
  specific aptamers
gguaggauuggcaugugguagau

SEQ ID NO: 460 - RNA, 23 nt, Artificial sequence
  specific aptamers
gguaggauuggcaugugguagcu

SEQ ID NO: 461 - RNA, 23 nt, Artificial sequence
  specific aptamers
gguaggauuggcaugugguaggu

SEQ ID NO: 462 - RNA, 23 nt, Artificial sequence
  specific aptamers
gguaggauuggcaugugguaguu

SEQ ID NO: 463 - RNA, 22 nt, Artificial sequence
  specific aptamers
gguaggauuggcaugugguagu

SEQ ID NO: 464 - RNA, 23 nt, Artificial sequence
  specific aptamers
gguaggauuggcaugugguauau

SEQ ID NO: 465 - RNA, 23 nt, Artificial sequence
  specific aptamers
gguaggauuggcaugugguaucu

SEQ ID NO: 466 - RNA, 23 nt, Artificial sequence
  specific aptamers
gguaggauuggcaugugguaugu

SEQ ID NO: 467 - RNA, 23 nt, Artificial sequence
  specific aptamers
gguaggauuggcaugugguauuu

SEQ ID NO: 468 - RNA, 22 nt, Artificial sequence
  specific aptamers
gguaggauuggcaugugguauu

SEQ ID NO: 469 - RNA, 23 nt, Artificial sequence
  specific aptamers
gguaggauugguaugugguaaau

SEQ ID NO: 470 - RNA, 23 nt, Artificial sequence
  specific aptamers
gguaggauugguaugugguaacu

SEQ ID NO: 471 - RNA, 23 nt, Artificial sequence
  specific aptamers
gguaggauugguaugugguaagu

SEQ ID NO: 472 - RNA, 23 nt, Artificial sequence
  specific aptamers
gguaggauugguaugugguaauu

SEQ ID NO: 473 - RNA, 22 nt, Artificial sequence
  specific aptamers
gguaggauugguaugugguaau

SEQ ID NO: 474 - RNA, 23 nt, Artificial sequence
  specific aptamers
gguaggauugguaugugguacau

SEQ ID NO: 475 - RNA, 23 nt, Artificial sequence
  specific aptamers
gguaggauugguaugugguaccu

SEQ ID NO: 476 - RNA, 23 nt, Artificial sequence
  specific aptamers
gguaggauugguaugugguacgu

SEQ ID NO: 477 - RNA, 23 nt, Artificial sequence
  specific aptamers
gguaggauugguaugugguacuu

SEQ ID NO: 478 - RNA, 22 nt, Artificial sequence
  specific aptamers
gguaggauugguaugugguacu

SEQ ID NO: 479 - RNA, 23 nt, Artificial sequence
  specific aptamers
gguaggauugguaugugguagau

SEQ ID NO: 480 - RNA, 23 nt, Artificial sequence
  specific aptamers
gguaggauugguaugugguagcu

SEQ ID NO: 481 - RNA, 23 nt, Artificial sequence
  specific aptamers
gguaggauugguaugugguaggu

SEQ ID NO: 482 - RNA, 23 nt, Artificial sequence
  specific aptamers
gguaggauugguaugugguaguu

SEQ ID NO: 483 - RNA, 22 nt, Artificial sequence
  specific aptamers
gguaggauugguaugugguagu

SEQ ID NO: 484 - RNA, 23 nt, Artificial sequence
  specific aptamers
gguaggauugguaugugguauau

SEQ ID NO: 485 - RNA, 23 nt, Artificial sequence
  specific aptamers
gguaggauugguaugugguaucu

SEQ ID NO: 486 - RNA, 23 nt, Artificial sequence
  specific aptamers
gguaggauugguaugugguaugu

SEQ ID NO: 487 - RNA, 23 nt, Artificial sequence
  specific aptamers
gguaggauugguaugugguauuu

SEQ ID NO: 488 - RNA, 22 nt, Artificial sequence
  specific aptamers
gguaggauugguaugugguauu

SEQ ID NO: 489 - RNA, 23 nt, Artificial sequence
  specific aptamers
ggaaggaauggaaugggguaaau

SEQ ID NO: 490 - RNA, 23 nt, Artificial sequence
  specific aptamers
ggaaggaauggaaugggguaacu

SEQ ID NO: 491 - RNA, 23 nt, Artificial sequence
  specific aptamers
ggaaggaauggaaugggguaagu

SEQ ID NO: 492 - RNA, 23 nt, Artificial sequence
  specific aptamers
ggaaggaauggaaugggguaauu

SEQ ID NO: 493 - RNA, 22 nt, Artificial sequence
  specific aptamers
ggaaggaauggaaugggguaau

SEQ ID NO: 494 - RNA, 23 nt, Artificial sequence
  specific aptamers
ggaaggaauggaaugggguacau

SEQ ID NO: 495 - RNA, 23 nt, Artificial sequence
  specific aptamers
ggaaggaauggaaugggguaccu

SEQ ID NO: 496 - RNA, 23 nt, Artificial sequence
  specific aptamers
ggaaggaauggaaugggguacgu

SEQ ID NO: 497 - RNA, 23 nt, Artificial sequence
  specific aptamers
ggaaggaauggaaugggguacuu

SEQ ID NO: 498 - RNA, 22 nt, Artificial sequence
  specific aptamers
ggaaggaauggaaugggguacu

SEQ ID NO: 499 - RNA, 23 nt, Artificial sequence
  specific aptamers
ggaaggaauggaaugggguagau

SEQ ID NO: 500 - RNA, 23 nt, Artificial sequence
  specific aptamers
ggaaggaauggaaugggguagcu

SEQ ID NO: 501 - RNA, 23 nt, Artificial sequence
  specific aptamers
ggaaggaauggaaugggguaggu

SEQ ID NO: 502 - RNA, 23 nt, Artificial sequence
  specific aptamers
ggaaggaauggaaugggguaguu

SEQ ID NO: 503 - RNA, 22 nt, Artificial sequence
  specific aptamers
ggaaggaauggaaugggguagu

SEQ ID NO: 504 - RNA, 23 nt, Artificial sequence
  specific aptamers
ggaaggaauggaaugggguauau

SEQ ID NO: 505 - RNA, 23 nt, Artificial sequence
  specific aptamers
ggaaggaauggaaugggguaucu

SEQ ID NO: 506 - RNA, 23 nt, Artificial sequence
  specific aptamers
ggaaggaauggaaugggguaugu

SEQ ID NO: 507 - RNA, 23 nt, Artificial sequence
  specific aptamers
ggaaggaauggaaugggguauuu

SEQ ID NO: 508 - RNA, 22 nt, Artificial sequence
  specific aptamers
ggaaggaauggaaugggguauu

SEQ ID NO: 509 - RNA, 23 nt, Artificial sequence
  specific aptamers
ggaaggaauggcaugggguaaau

SEQ ID NO: 510 - RNA, 23 nt, Artificial sequence
  specific aptamers
ggaaggaauggcaugggguaacu

SEQ ID NO: 511 - RNA, 23 nt, Artificial sequence
  specific aptamers
ggaaggaauggcaugggguaagu

SEQ ID NO: 512 - RNA, 23 nt, Artificial sequence
  specific aptamers
ggaaggaauggcaugggguaauu

SEQ ID NO: 513 - RNA, 22 nt, Artificial sequence
  specific aptamers
ggaaggaauggcaugggguaau

SEQ ID NO: 514 - RNA, 23 nt, Artificial sequence
  specific aptamers
ggaaggaauggcaugggguacau

SEQ ID NO: 515 - RNA, 23 nt, Artificial sequence
  specific aptamers
ggaaggaauggcaugggguaccu

SEQ ID NO: 516 - RNA, 23 nt, Artificial sequence
  specific aptamers
ggaaggaauggcaugggguacgu

SEQ ID NO: 517 - RNA, 23 nt, Artificial sequence
  specific aptamers
ggaaggaauggcaugggguacuu

SEQ ID NO: 518 - RNA, 22 nt, Artificial sequence
  specific aptamers
ggaaggaauggcaugggguacu

SEQ ID NO: 519 - RNA, 23 nt, Artificial sequence
  specific aptamers
ggaaggaauggcaugggguagau

SEQ ID NO: 520 - RNA, 23 nt, Artificial sequence
  specific aptamers
ggaaggaauggcaugggguagcu

SEQ ID NO: 521 - RNA, 23 nt, Artificial sequence
  specific aptamers
ggaaggaauggcaugggguaggu

SEQ ID NO: 522 - RNA, 23 nt, Artificial sequence
  specific aptamers
ggaaggaauggcaugggguaguu

SEQ ID NO: 523 - RNA, 22 nt, Artificial sequence
  specific aptamers
ggaaggaauggcaugggguagu

SEQ ID NO: 524 - RNA, 23 nt, Artificial sequence
  specific aptamers
ggaaggaauggcaugggguauau

SEQ ID NO: 525 - RNA, 23 nt, Artificial sequence
  specific aptamers
ggaaggaauggcaugggguaucu

SEQ ID NO: 526 - RNA, 23 nt, Artificial sequence
  specific aptamers
ggaaggaauggcaugggguaugu

SEQ ID NO: 527 - RNA, 23 nt, Artificial sequence
  specific aptamers
ggaaggaauggcaugggguauuu

SEQ ID NO: 528 - RNA, 22 nt, Artificial sequence
  specific aptamers
ggaaggaauggcaugggguauu

SEQ ID NO: 529 - RNA, 23 nt, Artificial sequence
  specific aptamers
ggaaggaaugguaugggguaaau

SEQ ID NO: 530 - RNA, 23 nt, Artificial sequence
  specific aptamers
ggaaggaaugguaugggguaacu

SEQ ID NO: 531 - RNA, 23 nt, Artificial sequence
  specific aptamers
ggaaggaaugguaugggguaagu

SEQ ID NO: 532 - RNA, 23 nt, Artificial sequence
  specific aptamers
ggaaggaaugguaugggguaauu

SEQ ID NO: 533 - RNA, 22 nt, Artificial sequence
  specific aptamers
ggaaggaaugguaugggguaau

SEQ ID NO: 534 - RNA, 23 nt, Artificial sequence
  specific aptamers
ggaaggaaugguaugggguacau

SEQ ID NO: 535 - RNA, 23 nt, Artificial sequence
  specific aptamers
ggaaggaaugguaugggguaccu

SEQ ID NO: 536 - RNA, 23 nt, Artificial sequence
  specific aptamers
ggaaggaaugguaugggguacgu

SEQ ID NO: 537 - RNA, 23 nt, Artificial sequence
  specific aptamers
ggaaggaaugguaugggguacuu

SEQ ID NO: 538 - RNA, 22 nt, Artificial sequence
  specific aptamers
ggaaggaaugguaugggguacu

SEQ ID NO: 539 - RNA, 23 nt, Artificial sequence
  specific aptamers
ggaaggaaugguaugggguagau

SEQ ID NO: 540 - RNA, 23 nt, Artificial sequence
  specific aptamers
ggaaggaaugguaugggguagcu

SEQ ID NO: 541 - RNA, 23 nt, Artificial sequence
  specific aptamers
ggaaggaaugguaugggguaggu

SEQ ID NO: 542 - RNA, 23 nt, Artificial sequence
  specific aptamers
ggaaggaaugguaugggguaguu

SEQ ID NO: 543 - RNA, 22 nt, Artificial sequence
  specific aptamers
ggaaggaaugguaugggguagu

SEQ ID NO: 544 - RNA, 23 nt, Artificial sequence
  specific aptamers
ggaaggaaugguaugggguauau

SEQ ID NO: 545 - RNA, 23 nt, Artificial sequence
  specific aptamers
ggaaggaaugguaugggguaucu

SEQ ID NO: 546 - RNA, 23 nt, Artificial sequence
  specific aptamers
ggaaggaaugguaugggguaugu

SEQ ID NO: 547 - RNA, 23 nt, Artificial sequence
  specific aptamers
ggaaggaaugguaugggguauuu

SEQ ID NO: 548 - RNA, 22 nt, Artificial sequence
  specific aptamers
ggaaggaaugguaugggguauu

SEQ ID NO: 549 - RNA, 23 nt, Artificial sequence
  specific aptamers
ggaaggauuggaaugggguaaau

SEQ ID NO: 550 - RNA, 23 nt, Artificial sequence
  specific aptamers
ggaaggauuggaaugggguaacu

SEQ ID NO: 551 - RNA, 23 nt, Artificial sequence
  specific aptamers
ggaaggauuggaaugggguaagu

SEQ ID NO: 552 - RNA, 23 nt, Artificial sequence
  specific aptamers
ggaaggauuggaaugggguaauu

SEQ ID NO: 553 - RNA, 22 nt, Artificial sequence
  specific aptamers
ggaaggauuggaaugggguaau

SEQ ID NO: 554 - RNA, 23 nt, Artificial sequence
  specific aptamers
ggaaggauuggaaugggguacau

SEQ ID NO: 555 - RNA, 23 nt, Artificial sequence
  specific aptamers
ggaaggauuggaaugggguaccu

SEQ ID NO: 556 - RNA, 23 nt, Artificial sequence
  specific aptamers
ggaaggauuggaaugggguacgu

SEQ ID NO: 557 - RNA, 23 nt, Artificial sequence
  specific aptamers
ggaaggauuggaaugggguacuu

SEQ ID NO: 558 - RNA, 22 nt, Artificial sequence
  specific aptamers
ggaaggauuggaaugggguacu

SEQ ID NO: 559 - RNA, 23 nt, Artificial sequence
  specific aptamers
ggaaggauuggaaugggguagau

SEQ ID NO: 560 - RNA, 23 nt, Artificial sequence
  specific aptamers
ggaaggauuggaaugggguagcu

SEQ ID NO: 561 - RNA, 23 nt, Artificial sequence
  specific aptamers
ggaaggauuggaaugggguaggu

SEQ ID NO: 562 - RNA, 23 nt, Artificial sequence
  specific aptamers
ggaaggauuggaaugggguaguu

SEQ ID NO: 563 - RNA, 22 nt, Artificial sequence
  specific aptamers
ggaaggauuggaaugggguagu

SEQ ID NO: 564 - RNA, 23 nt, Artificial sequence
  specific aptamers
ggaaggauuggaaugggguauau

SEQ ID NO: 565 - RNA, 23 nt, Artificial sequence
  specific aptamers
ggaaggauuggaaugggguaucu

SEQ ID NO: 566 - RNA, 23 nt, Artificial sequence
  specific aptamers
ggaaggauuggaaugggguaugu

SEQ ID NO: 567 - RNA, 23 nt, Artificial sequence
  specific aptamers
ggaaggauuggaaugggguauuu

SEQ ID NO: 568 - RNA, 22 nt, Artificial sequence
  specific aptamers
ggaaggauuggaaugggguauu

SEQ ID NO: 569 - RNA, 23 nt, Artificial sequence
  specific aptamers
ggaaggauuggcaugggguaaau

SEQ ID NO: 570 - RNA, 23 nt, Artificial sequence
  specific aptamers
ggaaggauuggcaugggguaacu

SEQ ID NO: 571 - RNA, 23 nt, Artificial sequence
  specific aptamers
ggaaggauuggcaugggguaagu

SEQ ID NO: 572 - RNA, 23 nt, Artificial sequence
  specific aptamers
ggaaggauuggcaugggguaauu

SEQ ID NO: 573 - RNA, 22 nt, Artificial sequence
  specific aptamers
ggaaggauuggcaugggguaau

SEQ ID NO: 574 - RNA, 23 nt, Artificial sequence
  specific aptamers
ggaaggauuggcaugggguacau

SEQ ID NO: 575 - RNA, 23 nt, Artificial sequence
  specific aptamers
ggaaggauuggcaugggguaccu

SEQ ID NO: 576 - RNA, 23 nt, Artificial sequence
  specific aptamers
ggaaggauuggcaugggguacgu

SEQ ID NO: 577 - RNA, 23 nt, Artificial sequence
  specific aptamers
ggaaggauuggcaugggguacuu

SEQ ID NO: 578 - RNA, 22 nt, Artificial sequence
  specific aptamers
ggaaggauuggcaugggguacu

SEQ ID NO: 579 - RNA, 23 nt, Artificial sequence
  specific aptamers
ggaaggauuggcaugggguagau

SEQ ID NO: 580 - RNA, 23 nt, Artificial sequence
  specific aptamers
ggaaggauuggcaugggguagcu

SEQ ID NO: 581 - RNA, 23 nt, Artificial sequence
  specific aptamers
ggaaggauuggcaugggguaggu

SEQ ID NO: 582 - RNA, 23 nt, Artificial sequence
  specific aptamers
ggaaggauuggcaugggguaguu

SEQ ID NO: 583 - RNA, 22 nt, Artificial sequence
  specific aptamers
ggaaggauuggcaugggguagu

SEQ ID NO: 584 - RNA, 23 nt, Artificial sequence
  specific aptamers
ggaaggauuggcaugggguauau

SEQ ID NO: 585 - RNA, 23 nt, Artificial sequence
  specific aptamers
ggaaggauuggcaugggguaucu

SEQ ID NO: 586 - RNA, 23 nt, Artificial sequence
  specific aptamers
ggaaggauuggcaugggguaugu

SEQ ID NO: 587 - RNA, 23 nt, Artificial sequence
  specific aptamers
ggaaggauuggcaugggguauuu

SEQ ID NO: 588 - RNA, 22 nt, Artificial sequence
  specific aptamers
ggaaggauuggcaugggguauu

SEQ ID NO: 589 - RNA, 23 nt, Artificial sequence
  specific aptamers
ggaaggauugguaugggguaaau

SEQ ID NO: 590 - RNA, 23 nt, Artificial sequence
  specific aptamers
ggaaggauugguaugggguaacu

SEQ ID NO: 591 - RNA, 23 nt, Artificial sequence
  specific aptamers
ggaaggauugguaugggguaagu

SEQ ID NO: 592 - RNA, 23 nt, Artificial sequence
  specific aptamers
ggaaggauugguaugggguaauu

SEQ ID NO: 593 - RNA, 22 nt, Artificial sequence
  specific aptamers
ggaaggauugguaugggguaau

SEQ ID NO: 594 - RNA, 23 nt, Artificial sequence
  specific aptamers
ggaaggauugguaugggguacau

SEQ ID NO: 595 - RNA, 23 nt, Artificial sequence
  specific aptamers
ggaaggauugguaugggguaccu

SEQ ID NO: 596 - RNA, 23 nt, Artificial sequence
  specific aptamers
ggaaggauugguaugggguacgu

SEQ ID NO: 597 - RNA, 23 nt, Artificial sequence
  specific aptamers
ggaaggauugguaugggguacuu

SEQ ID NO: 598 - RNA, 22 nt, Artificial sequence
  specific aptamers
ggaaggauugguaugggguacu

SEQ ID NO: 599 - RNA, 23 nt, Artificial sequence
  specific aptamers
ggaaggauugguaugggguagau

SEQ ID NO: 600 - RNA, 23 nt, Artificial sequence
  specific aptamers
ggaaggauugguaugggguagcu

SEQ ID NO: 601 - RNA, 23 nt, Artificial sequence
  specific aptamers
ggaaggauugguaugggguaggu

SEQ ID NO: 602 - RNA, 23 nt, Artificial sequence
  specific aptamers
ggaaggauugguaugggguaguu

SEQ ID NO: 603 - RNA, 22 nt, Artificial sequence
  specific aptamers
ggaaggauugguaugggguagu

SEQ ID NO: 604 - RNA, 23 nt, Artificial sequence
  specific aptamers
ggaaggauugguaugggguauau

SEQ ID NO: 605 - RNA, 23 nt, Artificial sequence
  specific aptamers
ggaaggauugguaugggguaucu

SEQ ID NO: 606 - RNA, 23 nt, Artificial sequence
  specific aptamers
ggaaggauugguaugggguaugu

SEQ ID NO: 607 - RNA, 23 nt, Artificial sequence
  specific aptamers
ggaaggauugguaugggguauuu

SEQ ID NO: 608 - RNA, 22 nt, Artificial sequence
  specific aptamers
ggaaggauugguaugggguauu

SEQ ID NO: 609 - RNA, 23 nt, Artificial sequence
  specific aptamers
gguaggaauggaaugggguaaau

SEQ ID NO: 610 - RNA, 23 nt, Artificial sequence
  specific aptamers
gguaggaauggaaugggguaacu

SEQ ID NO: 611 - RNA, 23 nt, Artificial sequence
  specific aptamers
gguaggaauggaaugggguaagu

SEQ ID NO: 612 - RNA, 23 nt, Artificial sequence
  specific aptamers
gguaggaauggaaugggguaauu

SEQ ID NO: 613 - RNA, 22 nt, Artificial sequence
  specific aptamers
gguaggaauggaaugggguaau

SEQ ID NO: 614 - RNA, 23 nt, Artificial sequence
  specific aptamers
gguaggaauggaaugggguacau

SEQ ID NO: 615 - RNA, 23 nt, Artificial sequence
  specific aptamers
gguaggaauggaaugggguaccu

SEQ ID NO: 616 - RNA, 23 nt, Artificial sequence
  specific aptamers
gguaggaauggaaugggguacgu

SEQ ID NO: 617 - RNA, 23 nt, Artificial sequence
  specific aptamers
gguaggaauggaaugggguacuu

SEQ ID NO: 618 - RNA, 22 nt, Artificial sequence
  specific aptamers
gguaggaauggaaugggguacu

SEQ ID NO: 619 - RNA, 23 nt, Artificial sequence
  specific aptamers
gguaggaauggaaugggguagau

SEQ ID NO: 620 - RNA, 23 nt, Artificial sequence
  specific aptamers
gguaggaauggaaugggguagcu

SEQ ID NO: 621 - RNA, 23 nt, Artificial sequence
  specific aptamers
gguaggaauggaaugggguaggu

SEQ ID NO: 622 - RNA, 23 nt, Artificial sequence
  specific aptamers
gguaggaauggaaugggguaguu

SEQ ID NO: 623 - RNA, 22 nt, Artificial sequence
  specific aptamers
gguaggaauggaaugggguagu

SEQ ID NO: 624 - RNA, 23 nt, Artificial sequence
  specific aptamers
gguaggaauggaaugggguauau

SEQ ID NO: 625 - RNA, 23 nt, Artificial sequence
  specific aptamers
gguaggaauggaaugggguaucu

SEQ ID NO: 626 - RNA, 23 nt, Artificial sequence
  specific aptamers
gguaggaauggaaugggguaugu

SEQ ID NO: 627 - RNA, 23 nt, Artificial sequence
  specific aptamers
gguaggaauggaaugggguauuu

SEQ ID NO: 628 - RNA, 22 nt, Artificial sequence
  specific aptamers
gguaggaauggaaugggguauu

SEQ ID NO: 629 - RNA, 23 nt, Artificial sequence
  specific aptamers
gguaggaauggcaugggguaaau

SEQ ID NO: 630 - RNA, 23 nt, Artificial sequence
  specific aptamers
gguaggaauggcaugggguaacu

SEQ ID NO: 631 - RNA, 23 nt, Artificial sequence
  specific aptamers
gguaggaauggcaugggguaagu

SEQ ID NO: 632 - RNA, 23 nt, Artificial sequence
  specific aptamers
gguaggaauggcaugggguaauu

SEQ ID NO: 633 - RNA, 22 nt, Artificial sequence
  specific aptamers
gguaggaauggcaugggguaau

SEQ ID NO: 634 - RNA, 23 nt, Artificial sequence
  specific aptamers
gguaggaauggcaugggguacau

SEQ ID NO: 635 - RNA, 23 nt, Artificial sequence
  specific aptamers
gguaggaauggcaugggguaccu

SEQ ID NO: 636 - RNA, 23 nt, Artificial sequence
  specific aptamers
gguaggaauggcaugggguacgu

SEQ ID NO: 637 - RNA, 23 nt, Artificial sequence
  specific aptamers
gguaggaauggcaugggguacuu

SEQ ID NO: 638 - RNA, 22 nt, Artificial sequence
  specific aptamers
gguaggaauggcaugggguacu

SEQ ID NO: 639 - RNA, 23 nt, Artificial sequence
  specific aptamers
gguaggaauggcaugggguagau

SEQ ID NO: 640 - RNA, 23 nt, Artificial sequence
  specific aptamers
gguaggaauggcaugggguagcu

SEQ ID NO: 641 - RNA, 23 nt, Artificial sequence
  specific aptamers
gguaggaauggcaugggguaggu

SEQ ID NO: 642 - RNA, 23 nt, Artificial sequence
  specific aptamers
gguaggaauggcaugggguaguu

SEQ ID NO: 643 - RNA, 22 nt, Artificial sequence
  specific aptamers
gguaggaauggcaugggguagu

SEQ ID NO: 644 - RNA, 23 nt, Artificial sequence
  specific aptamers
gguaggaauggcaugggguauau

SEQ ID NO: 645 - RNA, 23 nt, Artificial sequence
  specific aptamers
gguaggaauggcaugggguaucu

SEQ ID NO: 646 - RNA, 23 nt, Artificial sequence
  specific aptamers
gguaggaauggcaugggguaugu

SEQ ID NO: 647 - RNA, 23 nt, Artificial sequence
  specific aptamers
gguaggaauggcaugggguauuu

SEQ ID NO: 648 - RNA, 22 nt, Artificial sequence
  specific aptamers
gguaggaauggcaugggguauu

SEQ ID NO: 649 - RNA, 23 nt, Artificial sequence
  specific aptamers
gguaggaaugguaugggguaaau

SEQ ID NO: 650 - RNA, 23 nt, Artificial sequence
  specific aptamers
gguaggaaugguaugggguaacu

SEQ ID NO: 651 - RNA, 23 nt, Artificial sequence
  specific aptamers
gguaggaaugguaugggguaagu

SEQ ID NO: 652 - RNA, 23 nt, Artificial sequence
  specific aptamers
gguaggaaugguaugggguaauu

SEQ ID NO: 653 - RNA, 22 nt, Artificial sequence
  specific aptamers
gguaggaaugguaugggguaau

SEQ ID NO: 654 - RNA, 23 nt, Artificial sequence
  specific aptamers
gguaggaaugguaugggguacau

SEQ ID NO: 655 - RNA, 23 nt, Artificial sequence
  specific aptamers
gguaggaaugguaugggguaccu

SEQ ID NO: 656 - RNA, 23 nt, Artificial sequence
  specific aptamers
gguaggaaugguaugggguacgu

SEQ ID NO: 657 - RNA, 23 nt, Artificial sequence
  specific aptamers
gguaggaaugguaugggguacuu

SEQ ID NO: 658 - RNA, 22 nt, Artificial sequence
  specific aptamers
gguaggaaugguaugggguacu

SEQ ID NO: 659 - RNA, 23 nt, Artificial sequence
  specific aptamers
gguaggaaugguaugggguagau

SEQ ID NO: 660 - RNA, 23 nt, Artificial sequence
  specific aptamers
gguaggaaugguaugggguagcu

SEQ ID NO: 661 - RNA, 23 nt, Artificial sequence
  specific aptamers
gguaggaaugguaugggguaggu

SEQ ID NO: 662 - RNA, 23 nt, Artificial sequence
  specific aptamers
gguaggaaugguaugggguaguu

SEQ ID NO: 663 - RNA, 22 nt, Artificial sequence
  specific aptamers
gguaggaaugguaugggguagu

SEQ ID NO: 664 - RNA, 23 nt, Artificial sequence
  specific aptamers
gguaggaaugguaugggguauau

SEQ ID NO: 665 - RNA, 23 nt, Artificial sequence
  specific aptamers
gguaggaaugguaugggguaucu

SEQ ID NO: 666 - RNA, 23 nt, Artificial sequence
  specific aptamers
gguaggaaugguaugggguaugu

SEQ ID NO: 667 - RNA, 23 nt, Artificial sequence
  specific aptamers
gguaggaaugguaugggguauuu

SEQ ID NO: 668 - RNA, 22 nt, Artificial sequence
  specific aptamers
gguaggaaugguaugggguauu

SEQ ID NO: 669 - RNA, 23 nt, Artificial sequence
  specific aptamers
gguaggauuggaaugggguaaau

SEQ ID NO: 670 - RNA, 23 nt, Artificial sequence
  specific aptamers
gguaggauuggaaugggguaacu

SEQ ID NO: 671 - RNA, 23 nt, Artificial sequence
  specific aptamers
gguaggauuggaaugggguaagu

SEQ ID NO: 672 - RNA, 23 nt, Artificial sequence
  specific aptamers
gguaggauuggaaugggguaauu

SEQ ID NO: 673 - RNA, 22 nt, Artificial sequence
  specific aptamers
gguaggauuggaaugggguaau

SEQ ID NO: 674 - RNA, 23 nt, Artificial sequence
  specific aptamers
gguaggauuggaaugggguacau

SEQ ID NO: 675 - RNA, 23 nt, Artificial sequence
  specific aptamers
gguaggauuggaaugggguaccu

SEQ ID NO: 676 - RNA, 23 nt, Artificial sequence
  specific aptamers
gguaggauuggaaugggguacgu

SEQ ID NO: 677 - RNA, 23 nt, Artificial sequence
  specific aptamers
gguaggauuggaaugggguacuu

SEQ ID NO: 678 - RNA, 22 nt, Artificial sequence
  specific aptamers
gguaggauuggaaugggguacu

SEQ ID NO: 679 - RNA, 23 nt, Artificial sequence
  specific aptamers
gguaggauuggaaugggguagau

SEQ ID NO: 680 - RNA, 23 nt, Artificial sequence
  specific aptamers
gguaggauuggaaugggguagcu

SEQ ID NO: 681 - RNA, 23 nt, Artificial sequence
  specific aptamers
gguaggauuggaaugggguaggu

SEQ ID NO: 682 - RNA, 23 nt, Artificial sequence
  specific aptamers
gguaggauuggaaugggguaguu

SEQ ID NO: 683 - RNA, 22 nt, Artificial sequence
  specific aptamers
gguaggauuggaaugggguagu

SEQ ID NO: 684 - RNA, 23 nt, Artificial sequence
  specific aptamers
gguaggauuggaaugggguauau

SEQ ID NO: 685 - RNA, 23 nt, Artificial sequence
  specific aptamers
gguaggauuggaaugggguaucu

SEQ ID NO: 686 - RNA, 23 nt, Artificial sequence
  specific aptamers
gguaggauuggaaugggguaugu

SEQ ID NO: 687 - RNA, 23 nt, Artificial sequence
  specific aptamers
gguaggauuggaaugggguauuu

SEQ ID NO: 688 - RNA, 22 nt, Artificial sequence
  specific aptamers
gguaggauuggaaugggguauu

SEQ ID NO: 689 - RNA, 23 nt, Artificial sequence
  specific aptamers
gguaggauuggcaugggguaaau

SEQ ID NO: 690 - RNA, 23 nt, Artificial sequence
  specific aptamers
gguaggauuggcaugggguaacu

SEQ ID NO: 691 - RNA, 23 nt, Artificial sequence
  specific aptamers
gguaggauuggcaugggguaagu

SEQ ID NO: 692 - RNA, 23 nt, Artificial sequence
  specific aptamers
gguaggauuggcaugggguaauu

SEQ ID NO: 693 - RNA, 22 nt, Artificial sequence
  specific aptamers
gguaggauuggcaugggguaau

SEQ ID NO: 694 - RNA, 23 nt, Artificial sequence
  specific aptamers
gguaggauuggcaugggguacau

SEQ ID NO: 695 - RNA, 23 nt, Artificial sequence
  specific aptamers
gguaggauuggcaugggguaccu

SEQ ID NO: 696 - RNA, 23 nt, Artificial sequence
  specific aptamers
gguaggauuggcaugggguacgu

SEQ ID NO: 697 - RNA, 23 nt, Artificial sequence
  specific aptamers
gguaggauuggcaugggguacuu

SEQ ID NO: 698 - RNA, 22 nt, Artificial sequence
  specific aptamers
gguaggauuggcaugggguacu

SEQ ID NO: 699 - RNA, 23 nt, Artificial sequence
  specific aptamers
gguaggauuggcaugggguagau

SEQ ID NO: 700 - RNA, 23 nt, Artificial sequence
  specific aptamers
gguaggauuggcaugggguagcu

SEQ ID NO: 701 - RNA, 23 nt, Artificial sequence
  specific aptamers
gguaggauuggcaugggguaggu

SEQ ID NO: 702 - RNA, 23 nt, Artificial sequence
  specific aptamers
gguaggauuggcaugggguaguu

SEQ ID NO: 703 - RNA, 22 nt, Artificial sequence
  specific aptamers
gguaggauuggcaugggguagu

SEQ ID NO: 704 - RNA, 23 nt, Artificial sequence
  specific aptamers
gguaggauuggcaugggguauau

SEQ ID NO: 705 - RNA, 23 nt, Artificial sequence
  specific aptamers
gguaggauuggcaugggguaucu

SEQ ID NO: 706 - RNA, 23 nt, Artificial sequence
  specific aptamers
gguaggauuggcaugggguaugu

SEQ ID NO: 707 - RNA, 23 nt, Artificial sequence
  specific aptamers
gguaggauuggcaugggguauuu

SEQ ID NO: 708 - RNA, 22 nt, Artificial sequence
  specific aptamers
gguaggauuggcaugggguauu

SEQ ID NO: 709 - RNA, 23 nt, Artificial sequence
  specific aptamers
gguaggauugguaugggguaaau

SEQ ID NO: 710 - RNA, 23 nt, Artificial sequence
  specific aptamers
gguaggauugguaugggguaacu

SEQ ID NO: 711 - RNA, 23 nt, Artificial sequence
  specific aptamers
gguaggauugguaugggguaagu

SEQ ID NO: 712 - RNA, 23 nt, Artificial sequence
  specific aptamers
gguaggauugguaugggguaauu

SEQ ID NO: 713 - RNA, 22 nt, Artificial sequence
  specific aptamers
gguaggauugguaugggguaau

SEQ ID NO: 714 - RNA, 23 nt, Artificial sequence
  specific aptamers
gguaggauugguaugggguacau

SEQ ID NO: 715 - RNA, 23 nt, Artificial sequence
  specific aptamers
gguaggauugguaugggguaccu

SEQ ID NO: 716 - RNA, 23 nt, Artificial sequence
  specific aptamers
gguaggauugguaugggguacgu

SEQ ID NO: 717 - RNA, 23 nt, Artificial sequence
  specific aptamers
gguaggauugguaugggguacuu

SEQ ID NO: 718 - RNA, 22 nt, Artificial sequence
  specific aptamers
gguaggauugguaugggguacu

SEQ ID NO: 719 - RNA, 23 nt, Artificial sequence
  specific aptamers
gguaggauugguaugggguagau

SEQ ID NO: 720 - RNA, 23 nt, Artificial sequence
  specific aptamers
gguaggauugguaugggguagcu

SEQ ID NO: 721 - RNA, 23 nt, Artificial sequence
  specific aptamers
gguaggauugguaugggguaggu

SEQ ID NO: 722 - RNA, 23 nt, Artificial sequence
  specific aptamers
gguaggauugguaugggguaguu

SEQ ID NO: 723 - RNA, 22 nt, Artificial sequence
  specific aptamers
gguaggauugguaugggguagu

SEQ ID NO: 724 - RNA, 23 nt, Artificial sequence
  specific aptamers
gguaggauugguaugggguauau

SEQ ID NO: 725 - RNA, 23 nt, Artificial sequence
  specific aptamers
gguaggauugguaugggguaucu

SEQ ID NO: 726 - RNA, 23 nt, Artificial sequence
  specific aptamers
gguaggauugguaugggguaugu

SEQ ID NO: 727 - RNA, 23 nt, Artificial sequence
  specific aptamers
gguaggauugguaugggguauuu

SEQ ID NO: 728 - RNA, 22 nt, Artificial sequence
  specific aptamers
gguaggauugguaugggguauu

SEQ ID NO: 729 - RNA, 23 nt, Artificial sequence
  specific aptamers
ggacggaauggaaugugguaaag

SEQ ID NO: 730 - RNA, 23 nt, Artificial sequence
  specific aptamers
ggacggaauggaaugugguaacg

SEQ ID NO: 731 - RNA, 23 nt, Artificial sequence
  specific aptamers
ggacggaauggaaugugguaagg

SEQ ID NO: 732 - RNA, 23 nt, Artificial sequence
  specific aptamers
ggacggaauggaaugugguaaug

SEQ ID NO: 733 - RNA, 22 nt, Artificial sequence
  specific aptamers
ggacggaauggaaugugguaag

SEQ ID NO: 734 - RNA, 23 nt, Artificial sequence
  specific aptamers
ggacggaauggaaugugguacag

SEQ ID NO: 735 - RNA, 23 nt, Artificial sequence
  specific aptamers
ggacggaauggaaugugguaccg

SEQ ID NO: 736 - RNA, 23 nt, Artificial sequence
  specific aptamers
ggacggaauggaaugugguacgg

SEQ ID NO: 737 - RNA, 23 nt, Artificial sequence
  specific aptamers
ggacggaauggaaugugguacug

SEQ ID NO: 738 - RNA, 22 nt, Artificial sequence
  specific aptamers
ggacggaauggaaugugguacg

SEQ ID NO: 739 - RNA, 23 nt, Artificial sequence
  specific aptamers
ggacggaauggaaugugguagag

SEQ ID NO: 740 - RNA, 23 nt, Artificial sequence
  specific aptamers
ggacggaauggaaugugguagcg

SEQ ID NO: 741 - RNA, 23 nt, Artificial sequence
  specific aptamers
ggacggaauggaaugugguaggg

SEQ ID NO: 742 - RNA, 23 nt, Artificial sequence
  specific aptamers
ggacggaauggaaugugguagug

SEQ ID NO: 743 - RNA, 22 nt, Artificial sequence
  specific aptamers
ggacggaauggaaugugguagg

SEQ ID NO: 744 - RNA, 23 nt, Artificial sequence
  specific aptamers
ggacggaauggaaugugguauag

SEQ ID NO: 745 - RNA, 23 nt, Artificial sequence
  specific aptamers
ggacggaauggaaugugguaucg

SEQ ID NO: 746 - RNA, 23 nt, Artificial sequence
  specific aptamers
ggacggaauggaaugugguaugg

SEQ ID NO: 747 - RNA, 23 nt, Artificial sequence
  specific aptamers
ggacggaauggaaugugguauug

SEQ ID NO: 748 - RNA, 22 nt, Artificial sequence
  specific aptamers
ggacggaauggaaugugguaug

SEQ ID NO: 749 - RNA, 23 nt, Artificial sequence
  specific aptamers
ggacggaauggcaugugguaaag

SEQ ID NO: 750 - RNA, 23 nt, Artificial sequence
  specific aptamers
ggacggaauggcaugugguaacg

SEQ ID NO: 751 - RNA, 23 nt, Artificial sequence
  specific aptamers
ggacggaauggcaugugguaagg

SEQ ID NO: 752 - RNA, 23 nt, Artificial sequence
  specific aptamers
ggacggaauggcaugugguaaug

SEQ ID NO: 753 - RNA, 22 nt, Artificial sequence
  specific aptamers
ggacggaauggcaugugguaag

SEQ ID NO: 754 - RNA, 23 nt, Artificial sequence
  specific aptamers
ggacggaauggcaugugguacag

SEQ ID NO: 755 - RNA, 23 nt, Artificial sequence
  specific aptamers
ggacggaauggcaugugguaccg

SEQ ID NO: 756 - RNA, 23 nt, Artificial sequence
  specific aptamers
ggacggaauggcaugugguacgg

SEQ ID NO: 757 - RNA, 23 nt, Artificial sequence
  specific aptamers
ggacggaauggcaugugguacug

SEQ ID NO: 758 - RNA, 22 nt, Artificial sequence
  specific aptamers
ggacggaauggcaugugguacg

SEQ ID NO: 759 - RNA, 23 nt, Artificial sequence
  specific aptamers
ggacggaauggcaugugguagag

SEQ ID NO: 760 - RNA, 23 nt, Artificial sequence
  specific aptamers
ggacggaauggcaugugguagcg

SEQ ID NO: 761 - RNA, 23 nt, Artificial sequence
  specific aptamers
ggacggaauggcaugugguaggg

SEQ ID NO: 762 - RNA, 23 nt, Artificial sequence
  specific aptamers
ggacggaauggcaugugguagug

SEQ ID NO: 763 - RNA, 22 nt, Artificial sequence
  specific aptamers
ggacggaauggcaugugguagg

SEQ ID NO: 764 - RNA, 23 nt, Artificial sequence
  specific aptamers
ggacggaauggcaugugguauag

SEQ ID NO: 765 - RNA, 23 nt, Artificial sequence
  specific aptamers
ggacggaauggcaugugguaucg

SEQ ID NO: 766 - RNA, 23 nt, Artificial sequence
  specific aptamers
ggacggaauggcaugugguaugg

SEQ ID NO: 767 - RNA, 23 nt, Artificial sequence
  specific aptamers
ggacggaauggcaugugguauug

SEQ ID NO: 768 - RNA, 22 nt, Artificial sequence
  specific aptamers
ggacggaauggcaugugguaug

SEQ ID NO: 769 - RNA, 23 nt, Artificial sequence
  specific aptamers
ggacggaaugguaugugguaaag

SEQ ID NO: 770 - RNA, 23 nt, Artificial sequence
  specific aptamers
ggacggaaugguaugugguaacg

SEQ ID NO: 771 - RNA, 23 nt, Artificial sequence
  specific aptamers
ggacggaaugguaugugguaagg

SEQ ID NO: 772 - RNA, 23 nt, Artificial sequence
  specific aptamers
ggacggaaugguaugugguaaug

SEQ ID NO: 773 - RNA, 22 nt, Artificial sequence
  specific aptamers
ggacggaaugguaugugguaag

SEQ ID NO: 774 - RNA, 23 nt, Artificial sequence
  specific aptamers
ggacggaaugguaugugguacag

SEQ ID NO: 775 - RNA, 23 nt, Artificial sequence
  specific aptamers
ggacggaaugguaugugguaccg

SEQ ID NO: 776 - RNA, 23 nt, Artificial sequence
  specific aptamers
ggacggaaugguaugugguacgg

SEQ ID NO: 777 - RNA, 23 nt, Artificial sequence
  specific aptamers
ggacggaaugguaugugguacug

SEQ ID NO: 778 - RNA, 22 nt, Artificial sequence
  specific aptamers
ggacggaaugguaugugguacg

SEQ ID NO: 779 - RNA, 23 nt, Artificial sequence
  specific aptamers
ggacggaaugguaugugguagag

SEQ ID NO: 780 - RNA, 23 nt, Artificial sequence
  specific aptamers
ggacggaaugguaugugguagcg

SEQ ID NO: 781 - RNA, 23 nt, Artificial sequence
  specific aptamers
ggacggaaugguaugugguaggg

SEQ ID NO: 782 - RNA, 23 nt, Artificial sequence
  specific aptamers
ggacggaaugguaugugguagug

SEQ ID NO: 783 - RNA, 22 nt, Artificial sequence
  specific aptamers
ggacggaaugguaugugguagg

SEQ ID NO: 784 - RNA, 23 nt, Artificial sequence
  specific aptamers
ggacggaaugguaugugguauag

SEQ ID NO: 785 - RNA, 23 nt, Artificial sequence
  specific aptamers
ggacggaaugguaugugguaucg

SEQ ID NO: 786 - RNA, 23 nt, Artificial sequence
  specific aptamers
ggacggaaugguaugugguaugg

SEQ ID NO: 787 - RNA, 23 nt, Artificial sequence
  specific aptamers
ggacggaaugguaugugguauug

SEQ ID NO: 788 - RNA, 22 nt, Artificial sequence
  specific aptamers
ggacggaaugguaugugguaug

SEQ ID NO: 789 - RNA, 23 nt, Artificial sequence
  specific aptamers
ggacggauuggaaugugguaaag

SEQ ID NO: 790 - RNA, 23 nt, Artificial sequence
  specific aptamers
ggacggauuggaaugugguaacg

SEQ ID NO: 791 - RNA, 23 nt, Artificial sequence
  specific aptamers
ggacggauuggaaugugguaagg

SEQ ID NO: 792 - RNA, 23 nt, Artificial sequence
  specific aptamers
ggacggauuggaaugugguaaug

SEQ ID NO: 793 - RNA, 22 nt, Artificial sequence
  specific aptamers
ggacggauuggaaugugguaag

SEQ ID NO: 794 - RNA, 23 nt, Artificial sequence
  specific aptamers
ggacggauuggaaugugguacag

SEQ ID NO: 795 - RNA, 23 nt, Artificial sequence
  specific aptamers
ggacggauuggaaugugguaccg

SEQ ID NO: 796 - RNA, 23 nt, Artificial sequence
  specific aptamers
ggacggauuggaaugugguacgg

SEQ ID NO: 797 - RNA, 23 nt, Artificial sequence
  specific aptamers
ggacggauuggaaugugguacug

SEQ ID NO: 798 - RNA, 22 nt, Artificial sequence
  specific aptamers
ggacggauuggaaugugguacg

SEQ ID NO: 799 - RNA, 23 nt, Artificial sequence
  specific aptamers
ggacggauuggaaugugguagag

SEQ ID NO: 800 - RNA, 23 nt, Artificial sequence
  specific aptamers
ggacggauuggaaugugguagcg

SEQ ID NO: 801 - RNA, 23 nt, Artificial sequence
  specific aptamers
ggacggauuggaaugugguaggg

SEQ ID NO: 802 - RNA, 23 nt, Artificial sequence
  specific aptamers
ggacggauuggaaugugguagug

SEQ ID NO: 803 - RNA, 22 nt, Artificial sequence
  specific aptamers
ggacggauuggaaugugguagg

SEQ ID NO: 804 - RNA, 23 nt, Artificial sequence
  specific aptamers
ggacggauuggaaugugguauag

SEQ ID NO: 805 - RNA, 23 nt, Artificial sequence
  specific aptamers
ggacggauuggaaugugguaucg

SEQ ID NO: 806 - RNA, 23 nt, Artificial sequence
  specific aptamers
ggacggauuggaaugugguaugg

SEQ ID NO: 807 - RNA, 23 nt, Artificial sequence
  specific aptamers
ggacggauuggaaugugguauug

SEQ ID NO: 808 - RNA, 22 nt, Artificial sequence
  specific aptamers
ggacggauuggaaugugguaug

SEQ ID NO: 809 - RNA, 23 nt, Artificial sequence
  specific aptamers
ggacggauuggcaugugguaaag

SEQ ID NO: 810 - RNA, 23 nt, Artificial sequence
  specific aptamers
ggacggauuggcaugugguaacg

SEQ ID NO: 811 - RNA, 23 nt, Artificial sequence
  specific aptamers
ggacggauuggcaugugguaagg

SEQ ID NO: 812 - RNA, 23 nt, Artificial sequence
  specific aptamers
ggacggauuggcaugugguaaug

SEQ ID NO: 813 - RNA, 22 nt, Artificial sequence
  specific aptamers
ggacggauuggcaugugguaag

SEQ ID NO: 814 - RNA, 23 nt, Artificial sequence
  specific aptamers
ggacggauuggcaugugguacag

SEQ ID NO: 815 - RNA, 23 nt, Artificial sequence
  specific aptamers
ggacggauuggcaugugguaccg

SEQ ID NO: 816 - RNA, 23 nt, Artificial sequence
  specific aptamers
ggacggauuggcaugugguacgg

SEQ ID NO: 817 - RNA, 23 nt, Artificial sequence
  specific aptamers
ggacggauuggcaugugguacug

SEQ ID NO: 818 - RNA, 22 nt, Artificial sequence
  specific aptamers
ggacggauuggcaugugguacg

SEQ ID NO: 819 - RNA, 23 nt, Artificial sequence
  specific aptamers
ggacggauuggcaugugguagag

SEQ ID NO: 820 - RNA, 23 nt, Artificial sequence
  specific aptamers
ggacggauuggcaugugguagcg

SEQ ID NO: 821 - RNA, 23 nt, Artificial sequence
  specific aptamers
ggacggauuggcaugugguaggg

SEQ ID NO: 822 - RNA, 23 nt, Artificial sequence
  specific aptamers
ggacggauuggcaugugguagug

SEQ ID NO: 823 - RNA, 22 nt, Artificial sequence
  specific aptamers
ggacggauuggcaugugguagg

SEQ ID NO: 824 - RNA, 23 nt, Artificial sequence
  specific aptamers
ggacggauuggcaugugguauag

SEQ ID NO: 825 - RNA, 23 nt, Artificial sequence
  specific aptamers
ggacggauuggcaugugguaucg

SEQ ID NO: 826 - RNA, 23 nt, Artificial sequence
  specific aptamers
ggacggauuggcaugugguaugg

SEQ ID NO: 827 - RNA, 23 nt, Artificial sequence
  specific aptamers
ggacggauuggcaugugguauug

SEQ ID NO: 828 - RNA, 22 nt, Artificial sequence
  specific aptamers
ggacggauuggcaugugguaug

SEQ ID NO: 829 - RNA, 23 nt, Artificial sequence
  specific aptamers
ggacggauugguaugugguaaag

SEQ ID NO: 830 - RNA, 23 nt, Artificial sequence
  specific aptamers
ggacggauugguaugugguaacg

SEQ ID NO: 831 - RNA, 23 nt, Artificial sequence
  specific aptamers
ggacggauugguaugugguaagg

SEQ ID NO: 832 - RNA, 23 nt, Artificial sequence
  specific aptamers
ggacggauugguaugugguaaug

SEQ ID NO: 833 - RNA, 22 nt, Artificial sequence
  specific aptamers
ggacggauugguaugugguaag

SEQ ID NO: 834 - RNA, 23 nt, Artificial sequence
  specific aptamers
ggacggauugguaugugguacag

SEQ ID NO: 835 - RNA, 23 nt, Artificial sequence
  specific aptamers
ggacggauugguaugugguaccg

SEQ ID NO: 836 - RNA, 23 nt, Artificial sequence
  specific aptamers
ggacggauugguaugugguacgg

SEQ ID NO: 837 - RNA, 23 nt, Artificial sequence
  specific aptamers
ggacggauugguaugugguacug

SEQ ID NO: 838 - RNA, 22 nt, Artificial sequence
  specific aptamers
ggacggauugguaugugguacg

SEQ ID NO: 839 - RNA, 23 nt, Artificial sequence
  specific aptamers
ggacggauugguaugugguagag

SEQ ID NO: 840 - RNA, 23 nt, Artificial sequence
  specific aptamers
ggacggauugguaugugguagcg

SEQ ID NO: 841 - RNA, 23 nt, Artificial sequence
  specific aptamers
ggacggauugguaugugguaggg

SEQ ID NO: 842 - RNA, 23 nt, Artificial sequence
  specific aptamers
ggacggauugguaugugguagug

SEQ ID NO: 843 - RNA, 22 nt, Artificial sequence
  specific aptamers
ggacggauugguaugugguagg

SEQ ID NO: 844 - RNA, 23 nt, Artificial sequence
  specific aptamers
ggacggauugguaugugguauag

SEQ ID NO: 845 - RNA, 23 nt, Artificial sequence
  specific aptamers
ggacggauugguaugugguaucg

SEQ ID NO: 846 - RNA, 23 nt, Artificial sequence
  specific aptamers
ggacggauugguaugugguaugg

SEQ ID NO: 847 - RNA, 23 nt, Artificial sequence
  specific aptamers
ggacggauugguaugugguauug

SEQ ID NO: 848 - RNA, 22 nt, Artificial sequence
  specific aptamers
ggacggauugguaugugguaug

SEQ ID NO: 849 - RNA, 23 nt, Artificial sequence
  specific aptamers
ggucggaauggaaugugguaaag

SEQ ID NO: 850 - RNA, 23 nt, Artificial sequence
  specific aptamers
ggucggaauggaaugugguaacg

SEQ ID NO: 851 - RNA, 23 nt, Artificial sequence
  specific aptamers
ggucggaauggaaugugguaagg

SEQ ID NO: 852 - RNA, 23 nt, Artificial sequence
  specific aptamers
ggucggaauggaaugugguaaug

SEQ ID NO: 853 - RNA, 22 nt, Artificial sequence
  specific aptamers
ggucggaauggaaugugguaag

SEQ ID NO: 854 - RNA, 23 nt, Artificial sequence
  specific aptamers
ggucggaauggaaugugguacag

SEQ ID NO: 855 - RNA, 23 nt, Artificial sequence
  specific aptamers
ggucggaauggaaugugguaccg

SEQ ID NO: 856 - RNA, 23 nt, Artificial sequence
  specific aptamers
ggucggaauggaaugugguacgg

SEQ ID NO: 857 - RNA, 23 nt, Artificial sequence
  specific aptamers
ggucggaauggaaugugguacug

SEQ ID NO: 858 - RNA, 22 nt, Artificial sequence
  specific aptamers
ggucggaauggaaugugguacg

SEQ ID NO: 859 - RNA, 23 nt, Artificial sequence
  specific aptamers
ggucggaauggaaugugguagag

SEQ ID NO: 860 - RNA, 23 nt, Artificial sequence
  specific aptamers
ggucggaauggaaugugguagcg

SEQ ID NO: 861 - RNA, 23 nt, Artificial sequence
  specific aptamers
ggucggaauggaaugugguaggg

SEQ ID NO: 862 - RNA, 23 nt, Artificial sequence
  specific aptamers
ggucggaauggaaugugguagug

SEQ ID NO: 863 - RNA, 22 nt, Artificial sequence
  specific aptamers
ggucggaauggaaugugguagg

SEQ ID NO: 864 - RNA, 23 nt, Artificial sequence
  specific aptamers
ggucggaauggaaugugguauag

SEQ ID NO: 865 - RNA, 23 nt, Artificial sequence
  specific aptamers
ggucggaauggaaugugguaucg

SEQ ID NO: 866 - RNA, 23 nt, Artificial sequence
  specific aptamers
ggucggaauggaaugugguaugg

SEQ ID NO: 867 - RNA, 23 nt, Artificial sequence
  specific aptamers
ggucggaauggaaugugguauug

SEQ ID NO: 868 - RNA, 22 nt, Artificial sequence
  specific aptamers
ggucggaauggaaugugguaug

SEQ ID NO: 869 - RNA, 23 nt, Artificial sequence
  specific aptamers
ggucggaauggcaugugguaaag

SEQ ID NO: 870 - RNA, 23 nt, Artificial sequence
  specific aptamers
ggucggaauggcaugugguaacg

SEQ ID NO: 871 - RNA, 23 nt, Artificial sequence
  specific aptamers
ggucggaauggcaugugguaagg

SEQ ID NO: 872 - RNA, 23 nt, Artificial sequence
  specific aptamers
ggucggaauggcaugugguaaug

SEQ ID NO: 873 - RNA, 22 nt, Artificial sequence
  specific aptamers
ggucggaauggcaugugguaag

SEQ ID NO: 874 - RNA, 23 nt, Artificial sequence
  specific aptamers
ggucggaauggcaugugguacag

SEQ ID NO: 875 - RNA, 23 nt, Artificial sequence
  specific aptamers
ggucggaauggcaugugguaccg

SEQ ID NO: 876 - RNA, 23 nt, Artificial sequence
  specific aptamers
ggucggaauggcaugugguacgg

SEQ ID NO: 877 - RNA, 23 nt, Artificial sequence
  specific aptamers
ggucggaauggcaugugguacug

SEQ ID NO: 878 - RNA, 22 nt, Artificial sequence
  specific aptamers
ggucggaauggcaugugguacg

SEQ ID NO: 879 - RNA, 23 nt, Artificial sequence
  specific aptamers
ggucggaauggcaugugguagag

SEQ ID NO: 880 - RNA, 23 nt, Artificial sequence
  specific aptamers
ggucggaauggcaugugguagcg

SEQ ID NO: 881 - RNA, 23 nt, Artificial sequence
  specific aptamers
ggucggaauggcaugugguaggg

SEQ ID NO: 882 - RNA, 23 nt, Artificial sequence
  specific aptamers
ggucggaauggcaugugguagug

SEQ ID NO: 883 - RNA, 22 nt, Artificial sequence
  specific aptamers
ggucggaauggcaugugguagg

SEQ ID NO: 884 - RNA, 23 nt, Artificial sequence
  specific aptamers
ggucggaauggcaugugguauag

SEQ ID NO: 885 - RNA, 23 nt, Artificial sequence
  specific aptamers
ggucggaauggcaugugguaucg

SEQ ID NO: 886 - RNA, 23 nt, Artificial sequence
  specific aptamers
ggucggaauggcaugugguaugg

SEQ ID NO: 887 - RNA, 23 nt, Artificial sequence
  specific aptamers
ggucggaauggcaugugguauug

SEQ ID NO: 888 - RNA, 22 nt, Artificial sequence
  specific aptamers
ggucggaauggcaugugguaug

SEQ ID NO: 889 - RNA, 23 nt, Artificial sequence
  specific aptamers
ggucggaaugguaugugguaaag

SEQ ID NO: 890 - RNA, 23 nt, Artificial sequence
  specific aptamers
ggucggaaugguaugugguaacg

SEQ ID NO: 891 - RNA, 23 nt, Artificial sequence
  specific aptamers
ggucggaaugguaugugguaagg

SEQ ID NO: 892 - RNA, 23 nt, Artificial sequence
  specific aptamers
ggucggaaugguaugugguaaug

SEQ ID NO: 893 - RNA, 22 nt, Artificial sequence
  specific aptamers
ggucggaaugguaugugguaag

SEQ ID NO: 894 - RNA, 23 nt, Artificial sequence
  specific aptamers
ggucggaaugguaugugguacag

SEQ ID NO: 895 - RNA, 23 nt, Artificial sequence
  specific aptamers
ggucggaaugguaugugguaccg

SEQ ID NO: 896 - RNA, 23 nt, Artificial sequence
  specific aptamers
ggucggaaugguaugugguacgg

SEQ ID NO: 897 - RNA, 23 nt, Artificial sequence
  specific aptamers
ggucggaaugguaugugguacug

SEQ ID NO: 898 - RNA, 22 nt, Artificial sequence
  specific aptamers
ggucggaaugguaugugguacg

SEQ ID NO: 899 - RNA, 23 nt, Artificial sequence
  specific aptamers
ggucggaaugguaugugguagag

SEQ ID NO: 900 - RNA, 23 nt, Artificial sequence
  specific aptamers
ggucggaaugguaugugguagcg

SEQ ID NO: 901 - RNA, 23 nt, Artificial sequence
  specific aptamers
ggucggaaugguaugugguaggg

SEQ ID NO: 902 - RNA, 23 nt, Artificial sequence
  specific aptamers
ggucggaaugguaugugguagug

SEQ ID NO: 903 - RNA, 22 nt, Artificial sequence
  specific aptamers
ggucggaaugguaugugguagg

SEQ ID NO: 904 - RNA, 23 nt, Artificial sequence
  specific aptamers
ggucggaaugguaugugguauag

SEQ ID NO: 905 - RNA, 23 nt, Artificial sequence
  specific aptamers
ggucggaaugguaugugguaucg

SEQ ID NO: 906 - RNA, 23 nt, Artificial sequence
  specific aptamers
ggucggaaugguaugugguaugg

SEQ ID NO: 907 - RNA, 23 nt, Artificial sequence
  specific aptamers
ggucggaaugguaugugguauug

SEQ ID NO: 908 - RNA, 22 nt, Artificial sequence
  specific aptamers
ggucggaaugguaugugguaug

SEQ ID NO: 909 - RNA, 23 nt, Artificial sequence
  specific aptamers
ggucggauuggaaugugguaaag

SEQ ID NO: 910 - RNA, 23 nt, Artificial sequence
  specific aptamers
ggucggauuggaaugugguaacg

SEQ ID NO: 911 - RNA, 23 nt, Artificial sequence
  specific aptamers
ggucggauuggaaugugguaagg

SEQ ID NO: 912 - RNA, 23 nt, Artificial sequence
  specific aptamers
ggucggauuggaaugugguaaug

SEQ ID NO: 913 - RNA, 22 nt, Artificial sequence
  specific aptamers
ggucggauuggaaugugguaag

SEQ ID NO: 914 - RNA, 23 nt, Artificial sequence
  specific aptamers
ggucggauuggaaugugguacag

SEQ ID NO: 915 - RNA, 23 nt, Artificial sequence
  specific aptamers
ggucggauuggaaugugguaccg

SEQ ID NO: 916 - RNA, 23 nt, Artificial sequence
  specific aptamers
ggucggauuggaaugugguacgg

SEQ ID NO: 917 - RNA, 23 nt, Artificial sequence
  specific aptamers
ggucggauuggaaugugguacug

SEQ ID NO: 918 - RNA, 22 nt, Artificial sequence
  specific aptamers
ggucggauuggaaugugguacg

SEQ ID NO: 919 - RNA, 23 nt, Artificial sequence
  specific aptamers
ggucggauuggaaugugguagag

SEQ ID NO: 920 - RNA, 23 nt, Artificial sequence
  specific aptamers
ggucggauuggaaugugguagcg

SEQ ID NO: 921 - RNA, 23 nt, Artificial sequence
  specific aptamers
ggucggauuggaaugugguaggg

SEQ ID NO: 922 - RNA, 23 nt, Artificial sequence
  specific aptamers
ggucggauuggaaugugguagug

SEQ ID NO: 923 - RNA, 22 nt, Artificial sequence
  specific aptamers
ggucggauuggaaugugguagg

SEQ ID NO: 924 - RNA, 23 nt, Artificial sequence
  specific aptamers
ggucggauuggaaugugguauag

SEQ ID NO: 925 - RNA, 23 nt, Artificial sequence
  specific aptamers
ggucggauuggaaugugguaucg

SEQ ID NO: 926 - RNA, 23 nt, Artificial sequence
  specific aptamers
ggucggauuggaaugugguaugg

SEQ ID NO: 927 - RNA, 23 nt, Artificial sequence
  specific aptamers
ggucggauuggaaugugguauug

SEQ ID NO: 928 - RNA, 22 nt, Artificial sequence
  specific aptamers
ggucggauuggaaugugguaug

SEQ ID NO: 929 - RNA, 23 nt, Artificial sequence
  specific aptamers
ggucggauuggcaugugguaaag

SEQ ID NO: 930 - RNA, 23 nt, Artificial sequence
  specific aptamers
ggucggauuggcaugugguaacg

SEQ ID NO: 931 - RNA, 23 nt, Artificial sequence
  specific aptamers
ggucggauuggcaugugguaagg

SEQ ID NO: 932 - RNA, 23 nt, Artificial sequence
  specific aptamers
ggucggauuggcaugugguaaug

SEQ ID NO: 933 - RNA, 22 nt, Artificial sequence
  specific aptamers
ggucggauuggcaugugguaag

SEQ ID NO: 934 - RNA, 23 nt, Artificial sequence
  specific aptamers
ggucggauuggcaugugguacag

SEQ ID NO: 935 - RNA, 23 nt, Artificial sequence
  specific aptamers
ggucggauuggcaugugguaccg

SEQ ID NO: 936 - RNA, 23 nt, Artificial sequence
  specific aptamers
ggucggauuggcaugugguacgg

SEQ ID NO: 937 - RNA, 23 nt, Artificial sequence
  specific aptamers
ggucggauuggcaugugguacug

SEQ ID NO: 938 - RNA, 22 nt, Artificial sequence
  specific aptamers
ggucggauuggcaugugguacg

SEQ ID NO: 939 - RNA, 23 nt, Artificial sequence
  specific aptamers
ggucggauuggcaugugguagag

SEQ ID NO: 940 - RNA, 23 nt, Artificial sequence
  specific aptamers
ggucggauuggcaugugguagcg

SEQ ID NO: 941 - RNA, 23 nt, Artificial sequence
  specific aptamers
ggucggauuggcaugugguaggg

SEQ ID NO: 942 - RNA, 23 nt, Artificial sequence
  specific aptamers
ggucggauuggcaugugguagug

SEQ ID NO: 943 - RNA, 22 nt, Artificial sequence
  specific aptamers
ggucggauuggcaugugguagg

SEQ ID NO: 944 - RNA, 23 nt, Artificial sequence
  specific aptamers
ggucggauuggcaugugguauag

SEQ ID NO: 945 - RNA, 23 nt, Artificial sequence
  specific aptamers
ggucggauuggcaugugguaucg

SEQ ID NO: 946 - RNA, 23 nt, Artificial sequence
  specific aptamers
ggucggauuggcaugugguaugg

SEQ ID NO: 947 - RNA, 23 nt, Artificial sequence
  specific aptamers
ggucggauuggcaugugguauug

SEQ ID NO: 948 - RNA, 22 nt, Artificial sequence
  specific aptamers
ggucggauuggcaugugguaug

SEQ ID NO: 949 - RNA, 23 nt, Artificial sequence
  specific aptamers
ggucggauugguaugugguaaag

SEQ ID NO: 950 - RNA, 23 nt, Artificial sequence
  specific aptamers
ggucggauugguaugugguaacg

SEQ ID NO: 951 - RNA, 23 nt, Artificial sequence
  specific aptamers
ggucggauugguaugugguaagg

SEQ ID NO: 952 - RNA, 23 nt, Artificial sequence
  specific aptamers
ggucggauugguaugugguaaug

SEQ ID NO: 953 - RNA, 22 nt, Artificial sequence
  specific aptamers
ggucggauugguaugugguaag

SEQ ID NO: 954 - RNA, 23 nt, Artificial sequence
  specific aptamers
ggucggauugguaugugguacag

SEQ ID NO: 955 - RNA, 23 nt, Artificial sequence
  specific aptamers
ggucggauugguaugugguaccg

SEQ ID NO: 956 - RNA, 23 nt, Artificial sequence
  specific aptamers
ggucggauugguaugugguacgg

SEQ ID NO: 957 - RNA, 23 nt, Artificial sequence
  specific aptamers
ggucggauugguaugugguacug

SEQ ID NO: 958 - RNA, 22 nt, Artificial sequence
  specific aptamers
ggucggauugguaugugguacg

SEQ ID NO: 959 - RNA, 23 nt, Artificial sequence
  specific aptamers
ggucggauugguaugugguagag

SEQ ID NO: 960 - RNA, 23 nt, Artificial sequence
  specific aptamers
ggucggauugguaugugguagcg

SEQ ID NO: 961 - RNA, 23 nt, Artificial sequence
  specific aptamers
ggucggauugguaugugguaggg

SEQ ID NO: 962 - RNA, 23 nt, Artificial sequence
  specific aptamers
ggucggauugguaugugguagug

SEQ ID NO: 963 - RNA, 22 nt, Artificial sequence
  specific aptamers
ggucggauugguaugugguagg

SEQ ID NO: 964 - RNA, 23 nt, Artificial sequence
  specific aptamers
ggucggauugguaugugguauag

SEQ ID NO: 965 - RNA, 23 nt, Artificial sequence
  specific aptamers
ggucggauugguaugugguaucg

SEQ ID NO: 966 - RNA, 23 nt, Artificial sequence
  specific aptamers
ggucggauugguaugugguaugg

SEQ ID NO: 967 - RNA, 23 nt, Artificial sequence
  specific aptamers
ggucggauugguaugugguauug

SEQ ID NO: 968 - RNA, 22 nt, Artificial sequence
  specific aptamers
ggucggauugguaugugguaug

SEQ ID NO: 969 - RNA, 23 nt, Artificial sequence
  specific aptamers
ggaaggaauggaaugagguaaau

SEQ ID NO: 970 - RNA, 23 nt, Artificial sequence
  specific aptamers
ggaaggaauggaaugagguaacu

SEQ ID NO: 971 - RNA, 23 nt, Artificial sequence
  specific aptamers
ggaaggaauggaaugagguaagu

SEQ ID NO: 972 - RNA, 23 nt, Artificial sequence
  specific aptamers
ggaaggaauggaaugagguaauu

SEQ ID NO: 973 - RNA, 22 nt, Artificial sequence
  specific aptamers
ggaaggaauggaaugagguaau

SEQ ID NO: 974 - RNA, 23 nt, Artificial sequence
  specific aptamers
ggaaggaauggaaugagguacau

SEQ ID NO: 975 - RNA, 23 nt, Artificial sequence
  specific aptamers
ggaaggaauggaaugagguaccu

SEQ ID NO: 976 - RNA, 23 nt, Artificial sequence
  specific aptamers
ggaaggaauggaaugagguacgu

SEQ ID NO: 977 - RNA, 23 nt, Artificial sequence
  specific aptamers
ggaaggaauggaaugagguacuu

SEQ ID NO: 978 - RNA, 22 nt, Artificial sequence
  specific aptamers
ggaaggaauggaaugagguacu

SEQ ID NO: 979 - RNA, 23 nt, Artificial sequence
  specific aptamers
ggaaggaauggaaugagguagau

SEQ ID NO: 980 - RNA, 23 nt, Artificial sequence
  specific aptamers
ggaaggaauggaaugagguagcu

SEQ ID NO: 981 - RNA, 23 nt, Artificial sequence
  specific aptamers
ggaaggaauggaaugagguaggu

SEQ ID NO: 982 - RNA, 23 nt, Artificial sequence
  specific aptamers
ggaaggaauggaaugagguaguu

SEQ ID NO: 983 - RNA, 22 nt, Artificial sequence
  specific aptamers
ggaaggaauggaaugagguagu

SEQ ID NO: 984 - RNA, 23 nt, Artificial sequence
  specific aptamers
ggaaggaauggaaugagguauau

SEQ ID NO: 985 - RNA, 23 nt, Artificial sequence
  specific aptamers
ggaaggaauggaaugagguaucu

SEQ ID NO: 986 - RNA, 23 nt, Artificial sequence
  specific aptamers
ggaaggaauggaaugagguaugu

SEQ ID NO: 987 - RNA, 23 nt, Artificial sequence
  specific aptamers
ggaaggaauggaaugagguauuu

SEQ ID NO: 988 - RNA, 22 nt, Artificial sequence
  specific aptamers
ggaaggaauggaaugagguauu

SEQ ID NO: 989 - RNA, 23 nt, Artificial sequence
  specific aptamers
ggaaggaauggcaugagguaaau

SEQ ID NO: 990 - RNA, 23 nt, Artificial sequence
  specific aptamers
ggaaggaauggcaugagguaacu

SEQ ID NO: 991 - RNA, 23 nt, Artificial sequence
  specific aptamers
ggaaggaauggcaugagguaagu

SEQ ID NO: 992 - RNA, 23 nt, Artificial sequence
  specific aptamers
ggaaggaauggcaugagguaauu

SEQ ID NO: 993 - RNA, 22 nt, Artificial sequence
  specific aptamers
ggaaggaauggcaugagguaau

SEQ ID NO: 994 - RNA, 23 nt, Artificial sequence
  specific aptamers
ggaaggaauggcaugagguacau

SEQ ID NO: 995 - RNA, 23 nt, Artificial sequence
  specific aptamers
ggaaggaauggcaugagguaccu

SEQ ID NO: 996 - RNA, 23 nt, Artificial sequence
  specific aptamers
ggaaggaauggcaugagguacgu

SEQ ID NO: 997 - RNA, 23 nt, Artificial sequence
  specific aptamers
ggaaggaauggcaugagguacuu

SEQ ID NO: 998 - RNA, 22 nt, Artificial sequence
  specific aptamers
ggaaggaauggcaugagguacu

SEQ ID NO: 999 - RNA, 23 nt, Artificial sequence
  specific aptamers
ggaaggaauggcaugagguagau

SEQ ID NO: 1000 - RNA, 23 nt, Artificial sequence
  specific aptamers
ggaaggaauggcaugagguagcu

SEQ ID NO: 1001 - RNA, 23 nt, Artificial sequence
  specific aptamers
ggaaggaauggcaugagguaggu

SEQ ID NO: 1002 - RNA, 23 nt, Artificial sequence
  specific aptamers
ggaaggaauggcaugagguaguu

SEQ ID NO: 1003 - RNA, 22 nt, Artificial sequence
  specific aptamers
ggaaggaauggcaugagguagu

SEQ ID NO: 1004 - RNA, 23 nt, Artificial sequence
  specific aptamers
ggaaggaauggcaugagguauau

SEQ ID NO: 1005 - RNA, 23 nt, Artificial sequence
  specific aptamers
ggaaggaauggcaugagguaucu

SEQ ID NO: 1006 - RNA, 23 nt, Artificial sequence
  specific aptamers
ggaaggaauggcaugagguaugu

SEQ ID NO: 1007 - RNA, 23 nt, Artificial sequence
  specific aptamers
ggaaggaauggcaugagguauuu

SEQ ID NO: 1008 - RNA, 22 nt, Artificial sequence
  specific aptamers
ggaaggaauggcaugagguauu

SEQ ID NO: 1009 - RNA, 23 nt, Artificial sequence
  specific aptamers
ggaaggaaugguaugagguaaau

SEQ ID NO: 1010 - RNA, 23 nt, Artificial sequence
  specific aptamers
ggaaggaaugguaugagguaacu

SEQ ID NO: 1011 - RNA, 23 nt, Artificial sequence
  specific aptamers
ggaaggaaugguaugagguaagu

SEQ ID NO: 1012 - RNA, 23 nt, Artificial sequence
  specific aptamers
ggaaggaaugguaugagguaauu

SEQ ID NO: 1013 - RNA, 22 nt, Artificial sequence
  specific aptamers
ggaaggaaugguaugagguaau

SEQ ID NO: 1014 - RNA, 23 nt, Artificial sequence
  specific aptamers
ggaaggaaugguaugagguacau

SEQ ID NO: 1015 - RNA, 23 nt, Artificial sequence
  specific aptamers
ggaaggaaugguaugagguaccu

SEQ ID NO: 1016 - RNA, 23 nt, Artificial sequence
  specific aptamers
ggaaggaaugguaugagguacgu

SEQ ID NO: 1017 - RNA, 23 nt, Artificial sequence
  specific aptamers
ggaaggaaugguaugagguacuu

SEQ ID NO: 1018 - RNA, 22 nt, Artificial sequence
  specific aptamers
ggaaggaaugguaugagguacu

SEQ ID NO: 1019 - RNA, 23 nt, Artificial sequence
  specific aptamers
ggaaggaaugguaugagguagau

SEQ ID NO: 1020 - RNA, 23 nt, Artificial sequence
  specific aptamers
ggaaggaaugguaugagguagcu

SEQ ID NO: 1021 - RNA, 23 nt, Artificial sequence
  specific aptamers
ggaaggaaugguaugagguaggu

SEQ ID NO: 1022 - RNA, 23 nt, Artificial sequence
  specific aptamers
ggaaggaaugguaugagguaguu

SEQ ID NO: 1023 - RNA, 22 nt, Artificial sequence
  specific aptamers
ggaaggaaugguaugagguagu

SEQ ID NO: 1024 - RNA, 23 nt, Artificial sequence
  specific aptamers
ggaaggaaugguaugagguauau

SEQ ID NO: 1025 - RNA, 23 nt, Artificial sequence
  specific aptamers
ggaaggaaugguaugagguaucu

SEQ ID NO: 1026 - RNA, 23 nt, Artificial sequence
  specific aptamers
ggaaggaaugguaugagguaugu

SEQ ID NO: 1027 - RNA, 23 nt, Artificial sequence
  specific aptamers
ggaaggaaugguaugagguauuu

SEQ ID NO: 1028 - RNA, 22 nt, Artificial sequence
  specific aptamers
ggaaggaaugguaugagguauu

SEQ ID NO: 1029 - RNA, 23 nt, Artificial sequence
  specific aptamers
ggaaggauuggaaugagguaaau

SEQ ID NO: 1030 - RNA, 23 nt, Artificial sequence
  specific aptamers
ggaaggauuggaaugagguaacu

SEQ ID NO: 1031 - RNA, 23 nt, Artificial sequence
  specific aptamers
ggaaggauuggaaugagguaagu

SEQ ID NO: 1032 - RNA, 23 nt, Artificial sequence
  specific aptamers
ggaaggauuggaaugagguaauu

SEQ ID NO: 1033 - RNA, 22 nt, Artificial sequence
  specific aptamers
ggaaggauuggaaugagguaau

SEQ ID NO: 1034 - RNA, 23 nt, Artificial sequence
  specific aptamers
ggaaggauuggaaugagguacau

SEQ ID NO: 1035 - RNA, 23 nt, Artificial sequence
  specific aptamers
ggaaggauuggaaugagguaccu

SEQ ID NO: 1036 - RNA, 23 nt, Artificial sequence
  specific aptamers
ggaaggauuggaaugagguacgu

SEQ ID NO: 1037 - RNA, 23 nt, Artificial sequence
  specific aptamers
ggaaggauuggaaugagguacuu

SEQ ID NO: 1038 - RNA, 22 nt, Artificial sequence
  specific aptamers
ggaaggauuggaaugagguacu

SEQ ID NO: 1039 - RNA, 23 nt, Artificial sequence
  specific aptamers
ggaaggauuggaaugagguagau

SEQ ID NO: 1040 - RNA, 23 nt, Artificial sequence
  specific aptamers
ggaaggauuggaaugagguagcu

SEQ ID NO: 1041 - RNA, 23 nt, Artificial sequence
  specific aptamers
ggaaggauuggaaugagguaggu

SEQ ID NO: 1042 - RNA, 23 nt, Artificial sequence
  specific aptamers
ggaaggauuggaaugagguaguu

SEQ ID NO: 1043 - RNA, 22 nt, Artificial sequence
  specific aptamers
ggaaggauuggaaugagguagu

SEQ ID NO: 1044 - RNA, 23 nt, Artificial sequence
  specific aptamers
ggaaggauuggaaugagguauau

SEQ ID NO: 1045 - RNA, 23 nt, Artificial sequence
  specific aptamers
ggaaggauuggaaugagguaucu

SEQ ID NO: 1046 - RNA, 23 nt, Artificial sequence
  specific aptamers
ggaaggauuggaaugagguaugu

SEQ ID NO: 1047 - RNA, 23 nt, Artificial sequence
  specific aptamers
ggaaggauuggaaugagguauuu

SEQ ID NO: 1048 - RNA, 22 nt, Artificial sequence
  specific aptamers
ggaaggauuggaaugagguauu

SEQ ID NO: 1049 - RNA, 23 nt, Artificial sequence
  specific aptamers
ggaaggauuggcaugagguaaau

SEQ ID NO: 1050 - RNA, 23 nt, Artificial sequence
  specific aptamers
ggaaggauuggcaugagguaacu

SEQ ID NO: 1051 - RNA, 23 nt, Artificial sequence
  specific aptamers
ggaaggauuggcaugagguaagu

SEQ ID NO: 1052 - RNA, 23 nt, Artificial sequence
  specific aptamers
ggaaggauuggcaugagguaauu

SEQ ID NO: 1053 - RNA, 22 nt, Artificial sequence
  specific aptamers
ggaaggauuggcaugagguaau

SEQ ID NO: 1054 - RNA, 23 nt, Artificial sequence
  specific aptamers
ggaaggauuggcaugagguacau

SEQ ID NO: 1055 - RNA, 23 nt, Artificial sequence
  specific aptamers
ggaaggauuggcaugagguaccu

SEQ ID NO: 1056 - RNA, 23 nt, Artificial sequence
  specific aptamers
ggaaggauuggcaugagguacgu

SEQ ID NO: 1057 - RNA, 23 nt, Artificial sequence
  specific aptamers
ggaaggauuggcaugagguacuu

SEQ ID NO: 1058 - RNA, 22 nt, Artificial sequence
  specific aptamers
ggaaggauuggcaugagguacu

SEQ ID NO: 1059 - RNA, 23 nt, Artificial sequence
  specific aptamers
ggaaggauuggcaugagguagau

SEQ ID NO: 1060 - RNA, 23 nt, Artificial sequence
  specific aptamers
ggaaggauuggcaugagguagcu

SEQ ID NO: 1061 - RNA, 23 nt, Artificial sequence
  specific aptamers
ggaaggauuggcaugagguaggu

SEQ ID NO: 1062 - RNA, 23 nt, Artificial sequence
  specific aptamers
ggaaggauuggcaugagguaguu

SEQ ID NO: 1063 - RNA, 22 nt, Artificial sequence
  specific aptamers
ggaaggauuggcaugagguagu

SEQ ID NO: 1064 - RNA, 23 nt, Artificial sequence
  specific aptamers
ggaaggauuggcaugagguauau

SEQ ID NO: 1065 - RNA, 23 nt, Artificial sequence
  specific aptamers
ggaaggauuggcaugagguaucu

SEQ ID NO: 1066 - RNA, 23 nt, Artificial sequence
  specific aptamers
ggaaggauuggcaugagguaugu

SEQ ID NO: 1067 - RNA, 23 nt, Artificial sequence
  specific aptamers
ggaaggauuggcaugagguauuu

SEQ ID NO: 1068 - RNA, 22 nt, Artificial sequence
  specific aptamers
ggaaggauuggcaugagguauu

SEQ ID NO: 1069 - RNA, 23 nt, Artificial sequence
  specific aptamers
ggaaggauugguaugagguaaau

SEQ ID NO: 1070 - RNA, 23 nt, Artificial sequence
  specific aptamers
ggaaggauugguaugagguaacu

SEQ ID NO: 1071 - RNA, 23 nt, Artificial sequence
  specific aptamers
ggaaggauugguaugagguaagu

SEQ ID NO: 1072 - RNA, 23 nt, Artificial sequence
  specific aptamers
ggaaggauugguaugagguaauu

SEQ ID NO: 1073 - RNA, 22 nt, Artificial sequence
  specific aptamers
ggaaggauugguaugagguaau

SEQ ID NO: 1074 - RNA, 23 nt, Artificial sequence
  specific aptamers
ggaaggauugguaugagguacau

SEQ ID NO: 1075 - RNA, 23 nt, Artificial sequence
  specific aptamers
ggaaggauugguaugagguaccu

SEQ ID NO: 1076 - RNA, 23 nt, Artificial sequence
  specific aptamers
ggaaggauugguaugagguacgu

SEQ ID NO: 1077 - RNA, 23 nt, Artificial sequence
  specific aptamers
ggaaggauugguaugagguacuu

SEQ ID NO: 1078 - RNA, 22 nt, Artificial sequence
  specific aptamers
ggaaggauugguaugagguacu

SEQ ID NO: 1079 - RNA, 23 nt, Artificial sequence
  specific aptamers
ggaaggauugguaugagguagau

SEQ ID NO: 1080 - RNA, 23 nt, Artificial sequence
  specific aptamers
ggaaggauugguaugagguagcu

SEQ ID NO: 1081 - RNA, 23 nt, Artificial sequence
  specific aptamers
ggaaggauugguaugagguaggu

SEQ ID NO: 1082 - RNA, 23 nt, Artificial sequence
  specific aptamers
ggaaggauugguaugagguaguu

SEQ ID NO: 1083 - RNA, 22 nt, Artificial sequence
  specific aptamers
ggaaggauugguaugagguagu

SEQ ID NO: 1084 - RNA, 23 nt, Artificial sequence
  specific aptamers
ggaaggauugguaugagguauau

SEQ ID NO: 1085 - RNA, 23 nt, Artificial sequence
  specific aptamers
ggaaggauugguaugagguaucu

SEQ ID NO: 1086 - RNA, 23 nt, Artificial sequence
  specific aptamers
ggaaggauugguaugagguaugu

SEQ ID NO: 1087 - RNA, 23 nt, Artificial sequence
  specific aptamers
ggaaggauugguaugagguauuu

SEQ ID NO: 1088 - RNA, 22 nt, Artificial sequence
  specific aptamers
ggaaggauugguaugagguauu

SEQ ID NO: 1089 - RNA, 23 nt, Artificial sequence
  specific aptamers
gguaggaauggaaugagguaaau

SEQ ID NO: 1090 - RNA, 23 nt, Artificial sequence
  specific aptamers
gguaggaauggaaugagguaacu

SEQ ID NO: 1091 - RNA, 23 nt, Artificial sequence
  specific aptamers
gguaggaauggaaugagguaagu

SEQ ID NO: 1092 - RNA, 23 nt, Artificial sequence
  specific aptamers
gguaggaauggaaugagguaauu

SEQ ID NO: 1093 - RNA, 22 nt, Artificial sequence
  specific aptamers
gguaggaauggaaugagguaau

SEQ ID NO: 1094 - RNA, 23 nt, Artificial sequence
  specific aptamers
gguaggaauggaaugagguacau

SEQ ID NO: 1095 - RNA, 23 nt, Artificial sequence
  specific aptamers
gguaggaauggaaugagguaccu

SEQ ID NO: 1096 - RNA, 23 nt, Artificial sequence
  specific aptamers
gguaggaauggaaugagguacgu

SEQ ID NO: 1097 - RNA, 23 nt, Artificial sequence
  specific aptamers
gguaggaauggaaugagguacuu

SEQ ID NO: 1098 - RNA, 22 nt, Artificial sequence
  specific aptamers
gguaggaauggaaugagguacu

SEQ ID NO: 1099 - RNA, 23 nt, Artificial sequence
  specific aptamers
gguaggaauggaaugagguagau

SEQ ID NO: 1100 - RNA, 23 nt, Artificial sequence
  specific aptamers
gguaggaauggaaugagguagcu

SEQ ID NO: 1101 - RNA, 23 nt, Artificial sequence
  specific aptamers
gguaggaauggaaugagguaggu

SEQ ID NO: 1102 - RNA, 23 nt, Artificial sequence
  specific aptamers
gguaggaauggaaugagguaguu

SEQ ID NO: 1103 - RNA, 22 nt, Artificial sequence
  specific aptamers
gguaggaauggaaugagguagu

SEQ ID NO: 1104 - RNA, 23 nt, Artificial sequence
  specific aptamers
gguaggaauggaaugagguauau

SEQ ID NO: 1105 - RNA, 23 nt, Artificial sequence
  specific aptamers
gguaggaauggaaugagguaucu

SEQ ID NO: 1106 - RNA, 23 nt, Artificial sequence
  specific aptamers
gguaggaauggaaugagguaugu

SEQ ID NO: 1107 - RNA, 23 nt, Artificial sequence
  specific aptamers
gguaggaauggaaugagguauuu

SEQ ID NO: 1108 - RNA, 22 nt, Artificial sequence
  specific aptamers
gguaggaauggaaugagguauu

SEQ ID NO: 1109 - RNA, 23 nt, Artificial sequence
  specific aptamers
gguaggaauggcaugagguaaau

SEQ ID NO: 1110 - RNA, 23 nt, Artificial sequence
  specific aptamers
gguaggaauggcaugagguaacu

SEQ ID NO: 1111 - RNA, 23 nt, Artificial sequence
  specific aptamers
gguaggaauggcaugagguaagu

SEQ ID NO: 1112 - RNA, 23 nt, Artificial sequence
  specific aptamers
gguaggaauggcaugagguaauu

SEQ ID NO: 1113 - RNA, 22 nt, Artificial sequence
  specific aptamers
gguaggaauggcaugagguaau

SEQ ID NO: 1114 - RNA, 23 nt, Artificial sequence
  specific aptamers
gguaggaauggcaugagguacau

SEQ ID NO: 1115 - RNA, 23 nt, Artificial sequence
  specific aptamers
gguaggaauggcaugagguaccu

SEQ ID NO: 1116 - RNA, 23 nt, Artificial sequence
  specific aptamers
gguaggaauggcaugagguacgu

SEQ ID NO: 1117 - RNA, 23 nt, Artificial sequence
  specific aptamers
gguaggaauggcaugagguacuu

SEQ ID NO: 1118 - RNA, 22 nt, Artificial sequence
  specific aptamers
gguaggaauggcaugagguacu

SEQ ID NO: 1119 - RNA, 23 nt, Artificial sequence
  specific aptamers
gguaggaauggcaugagguagau

SEQ ID NO: 1120 - RNA, 23 nt, Artificial sequence
  specific aptamers
gguaggaauggcaugagguagcu

SEQ ID NO: 1121 - RNA, 23 nt, Artificial sequence
  specific aptamers
gguaggaauggcaugagguaggu

SEQ ID NO: 1122 - RNA, 23 nt, Artificial sequence
  specific aptamers
gguaggaauggcaugagguaguu

SEQ ID NO: 1123 - RNA, 22 nt, Artificial sequence
  specific aptamers
gguaggaauggcaugagguagu

SEQ ID NO: 1124 - RNA, 23 nt, Artificial sequence
  specific aptamers
gguaggaauggcaugagguauau

SEQ ID NO: 1125 - RNA, 23 nt, Artificial sequence
  specific aptamers
gguaggaauggcaugagguaucu

SEQ ID NO: 1126 - RNA, 23 nt, Artificial sequence
  specific aptamers
gguaggaauggcaugagguaugu

SEQ ID NO: 1127 - RNA, 23 nt, Artificial sequence
  specific aptamers
gguaggaauggcaugagguauuu

SEQ ID NO: 1128 - RNA, 22 nt, Artificial sequence
  specific aptamers
gguaggaauggcaugagguauu

SEQ ID NO: 1129 - RNA, 23 nt, Artificial sequence
  specific aptamers
gguaggaaugguaugagguaaau

SEQ ID NO: 1130 - RNA, 23 nt, Artificial sequence
  specific aptamers
gguaggaaugguaugagguaacu

SEQ ID NO: 1131 - RNA, 23 nt, Artificial sequence
  specific aptamers
gguaggaaugguaugagguaagu

SEQ ID NO: 1132 - RNA, 23 nt, Artificial sequence
  specific aptamers
gguaggaaugguaugagguaauu

SEQ ID NO: 1133 - RNA, 22 nt, Artificial sequence
  specific aptamers
gguaggaaugguaugagguaau

SEQ ID NO: 1134 - RNA, 23 nt, Artificial sequence
  specific aptamers
gguaggaaugguaugagguacau

SEQ ID NO: 1135 - RNA, 23 nt, Artificial sequence
  specific aptamers
gguaggaaugguaugagguaccu

SEQ ID NO: 1136 - RNA, 23 nt, Artificial sequence
  specific aptamers
gguaggaaugguaugagguacgu

SEQ ID NO: 1137 - RNA, 23 nt, Artificial sequence
  specific aptamers
gguaggaaugguaugagguacuu

SEQ ID NO: 1138 - RNA, 22 nt, Artificial sequence
  specific aptamers
gguaggaaugguaugagguacu

SEQ ID NO: 1139 - RNA, 23 nt, Artificial sequence
  specific aptamers
gguaggaaugguaugagguagau

SEQ ID NO: 1140 - RNA, 23 nt, Artificial sequence
  specific aptamers
gguaggaaugguaugagguagcu

SEQ ID NO: 1141 - RNA, 23 nt, Artificial sequence
  specific aptamers
gguaggaaugguaugagguaggu

SEQ ID NO: 1142 - RNA, 23 nt, Artificial sequence
  specific aptamers
gguaggaaugguaugagguaguu

SEQ ID NO: 1143 - RNA, 22 nt, Artificial sequence
  specific aptamers
gguaggaaugguaugagguagu

SEQ ID NO: 1144 - RNA, 23 nt, Artificial sequence
  specific aptamers
gguaggaaugguaugagguauau

SEQ ID NO: 1145 - RNA, 23 nt, Artificial sequence
  specific aptamers
gguaggaaugguaugagguaucu

SEQ ID NO: 1146 - RNA, 23 nt, Artificial sequence
  specific aptamers
gguaggaaugguaugagguaugu

SEQ ID NO: 1147 - RNA, 23 nt, Artificial sequence
  specific aptamers
gguaggaaugguaugagguauuu

SEQ ID NO: 1148 - RNA, 22 nt, Artificial sequence
  specific aptamers
gguaggaaugguaugagguauu

SEQ ID NO: 1149 - RNA, 23 nt, Artificial sequence
  specific aptamers
gguaggauuggaaugagguaaau

SEQ ID NO: 1150 - RNA, 23 nt, Artificial sequence
  specific aptamers
gguaggauuggaaugagguaacu

SEQ ID NO: 1151 - RNA, 23 nt, Artificial sequence
  specific aptamers
gguaggauuggaaugagguaagu

SEQ ID NO: 1152 - RNA, 23 nt, Artificial sequence
  specific aptamers
gguaggauuggaaugagguaauu

SEQ ID NO: 1153 - RNA, 22 nt, Artificial sequence
  specific aptamers
gguaggauuggaaugagguaau

SEQ ID NO: 1154 - RNA, 23 nt, Artificial sequence
  specific aptamers
gguaggauuggaaugagguacau

SEQ ID NO: 1155 - RNA, 23 nt, Artificial sequence
  specific aptamers
gguaggauuggaaugagguaccu

SEQ ID NO: 1156 - RNA, 23 nt, Artificial sequence
  specific aptamers
gguaggauuggaaugagguacgu

SEQ ID NO: 1157 - RNA, 23 nt, Artificial sequence
  specific aptamers
gguaggauuggaaugagguacuu

SEQ ID NO: 1158 - RNA, 22 nt, Artificial sequence
  specific aptamers
gguaggauuggaaugagguacu

SEQ ID NO: 1159 - RNA, 23 nt, Artificial sequence
  specific aptamers
gguaggauuggaaugagguagau

SEQ ID NO: 1160 - RNA, 23 nt, Artificial sequence
  specific aptamers
gguaggauuggaaugagguagcu

SEQ ID NO: 1161 - RNA, 23 nt, Artificial sequence
  specific aptamers
gguaggauuggaaugagguaggu

SEQ ID NO: 1162 - RNA, 23 nt, Artificial sequence
  specific aptamers
gguaggauuggaaugagguaguu

SEQ ID NO: 1163 - RNA, 22 nt, Artificial sequence
  specific aptamers
gguaggauuggaaugagguagu

SEQ ID NO: 1164 - RNA, 23 nt, Artificial sequence
  specific aptamers
gguaggauuggaaugagguauau

SEQ ID NO: 1165 - RNA, 23 nt, Artificial sequence
  specific aptamers
gguaggauuggaaugagguaucu

SEQ ID NO: 1166 - RNA, 23 nt, Artificial sequence
  specific aptamers
gguaggauuggaaugagguaugu

SEQ ID NO: 1167 - RNA, 23 nt, Artificial sequence
  specific aptamers
gguaggauuggaaugagguauuu

SEQ ID NO: 1168 - RNA, 22 nt, Artificial sequence
  specific aptamers
gguaggauuggaaugagguauu

SEQ ID NO: 1169 - RNA, 23 nt, Artificial sequence
  specific aptamers
gguaggauuggcaugagguaaau

SEQ ID NO: 1170 - RNA, 23 nt, Artificial sequence
  specific aptamers
gguaggauuggcaugagguaacu

SEQ ID NO: 1171 - RNA, 23 nt, Artificial sequence
  specific aptamers
gguaggauuggcaugagguaagu

SEQ ID NO: 1172 - RNA, 23 nt, Artificial sequence
  specific aptamers
gguaggauuggcaugagguaauu

SEQ ID NO: 1173 - RNA, 22 nt, Artificial sequence
  specific aptamers
gguaggauuggcaugagguaau

SEQ ID NO: 1174 - RNA, 23 nt, Artificial sequence
  specific aptamers
gguaggauuggcaugagguacau

SEQ ID NO: 1175 - RNA, 23 nt, Artificial sequence
  specific aptamers
gguaggauuggcaugagguaccu

SEQ ID NO: 1176 - RNA, 23 nt, Artificial sequence
  specific aptamers
gguaggauuggcaugagguacgu

SEQ ID NO: 1177 - RNA, 23 nt, Artificial sequence
  specific aptamers
gguaggauuggcaugagguacuu

SEQ ID NO: 1178 - RNA, 22 nt, Artificial sequence
  specific aptamers
gguaggauuggcaugagguacu

SEQ ID NO: 1179 - RNA, 23 nt, Artificial sequence
  specific aptamers
gguaggauuggcaugagguagau

SEQ ID NO: 1180 - RNA, 23 nt, Artificial sequence
  specific aptamers
gguaggauuggcaugagguagcu

SEQ ID NO: 1181 - RNA, 23 nt, Artificial sequence
  specific aptamers
gguaggauuggcaugagguaggu

SEQ ID NO: 1182 - RNA, 23 nt, Artificial sequence
  specific aptamers
gguaggauuggcaugagguaguu

SEQ ID NO: 1183 - RNA, 22 nt, Artificial sequence
  specific aptamers
gguaggauuggcaugagguagu

SEQ ID NO: 1184 - RNA, 23 nt, Artificial sequence
  specific aptamers
gguaggauuggcaugagguauau

SEQ ID NO: 1185 - RNA, 23 nt, Artificial sequence
  specific aptamers
gguaggauuggcaugagguaucu

SEQ ID NO: 1186 - RNA, 23 nt, Artificial sequence
  specific aptamers
gguaggauuggcaugagguaugu

SEQ ID NO: 1187 - RNA, 23 nt, Artificial sequence
  specific aptamers
gguaggauuggcaugagguauuu

SEQ ID NO: 1188 - RNA, 22 nt, Artificial sequence
  specific aptamers
gguaggauuggcaugagguauu

SEQ ID NO: 1189 - RNA, 23 nt, Artificial sequence
  specific aptamers
gguaggauugguaugagguaaau

SEQ ID NO: 1190 - RNA, 23 nt, Artificial sequence
  specific aptamers
gguaggauugguaugagguaacu

SEQ ID NO: 1191 - RNA, 23 nt, Artificial sequence
  specific aptamers
gguaggauugguaugagguaagu

SEQ ID NO: 1192 - RNA, 23 nt, Artificial sequence
  specific aptamers
gguaggauugguaugagguaauu

SEQ ID NO: 1193 - RNA, 22 nt, Artificial sequence
  specific aptamers
gguaggauugguaugagguaau

SEQ ID NO: 1194 - RNA, 23 nt, Artificial sequence
  specific aptamers
gguaggauugguaugagguacau

SEQ ID NO: 1195 - RNA, 23 nt, Artificial sequence
  specific aptamers
gguaggauugguaugagguaccu

SEQ ID NO: 1196 - RNA, 23 nt, Artificial sequence
  specific aptamers
gguaggauugguaugagguacgu

SEQ ID NO: 1197 - RNA, 23 nt, Artificial sequence
  specific aptamers
gguaggauugguaugagguacuu

SEQ ID NO: 1198 - RNA, 22 nt, Artificial sequence
  specific aptamers
gguaggauugguaugagguacu

SEQ ID NO: 1199 - RNA, 23 nt, Artificial sequence
  specific aptamers
gguaggauugguaugagguagau

SEQ ID NO: 1200 - RNA, 23 nt, Artificial sequence
  specific aptamers
gguaggauugguaugagguagcu

SEQ ID NO: 1201 - RNA, 23 nt, Artificial sequence
  specific aptamers
gguaggauugguaugagguaggu

SEQ ID NO: 1202 - RNA, 23 nt, Artificial sequence
  specific aptamers
gguaggauugguaugagguaguu

SEQ ID NO: 1203 - RNA, 22 nt, Artificial sequence
  specific aptamers
gguaggauugguaugagguagu

SEQ ID NO: 1204 - RNA, 23 nt, Artificial sequence
  specific aptamers
gguaggauugguaugagguauau

SEQ ID NO: 1205 - RNA, 23 nt, Artificial sequence
  specific aptamers
gguaggauugguaugagguaucu

SEQ ID NO: 1206 - RNA, 23 nt, Artificial sequence
  specific aptamers
gguaggauugguaugagguaugu

SEQ ID NO: 1207 - RNA, 23 nt, Artificial sequence
  specific aptamers
gguaggauugguaugagguauuu

SEQ ID NO: 1208 - RNA, 22 nt, Artificial sequence
  specific aptamers
gguaggauugguaugagguauu

SEQ ID NO: 1209 - RNA, 23 nt, Artificial sequence
  specific aptamers
ggaagguauggaaugugguaaaa

SEQ ID NO: 1210 - RNA, 23 nt, Artificial sequence
  specific aptamers
ggaagguauggaaugugguaaca

SEQ ID NO: 1211 - RNA, 23 nt, Artificial sequence
  specific aptamers
ggaagguauggaaugugguaaga

SEQ ID NO: 1212 - RNA, 23 nt, Artificial sequence
  specific aptamers
ggaagguauggaaugugguaaua

SEQ ID NO: 1213 - RNA, 22 nt, Artificial sequence
  specific aptamers
ggaagguauggaaugugguaaa

SEQ ID NO: 1214 - RNA, 23 nt, Artificial sequence
  specific aptamers
ggaagguauggaaugugguacaa

SEQ ID NO: 1215 - RNA, 23 nt, Artificial sequence
  specific aptamers
ggaagguauggaaugugguacca

SEQ ID NO: 1216 - RNA, 23 nt, Artificial sequence
  specific aptamers
ggaagguauggaaugugguacga

SEQ ID NO: 1217 - RNA, 23 nt, Artificial sequence
  specific aptamers
ggaagguauggaaugugguacua

SEQ ID NO: 1218 - RNA, 22 nt, Artificial sequence
  specific aptamers
ggaagguauggaaugugguaca

SEQ ID NO: 1219 - RNA, 23 nt, Artificial sequence
  specific aptamers
ggaagguauggaaugugguagaa

SEQ ID NO: 1220 - RNA, 23 nt, Artificial sequence
  specific aptamers
ggaagguauggaaugugguagca

SEQ ID NO: 1221 - RNA, 23 nt, Artificial sequence
  specific aptamers
ggaagguauggaaugugguagga

SEQ ID NO: 1222 - RNA, 23 nt, Artificial sequence
  specific aptamers
ggaagguauggaaugugguagua

SEQ ID NO: 1223 - RNA, 22 nt, Artificial sequence
  specific aptamers
ggaagguauggaaugugguaga

SEQ ID NO: 1224 - RNA, 23 nt, Artificial sequence
  specific aptamers
ggaagguauggaaugugguauaa

SEQ ID NO: 1225 - RNA, 23 nt, Artificial sequence
  specific aptamers
ggaagguauggaaugugguauca

SEQ ID NO: 1226 - RNA, 23 nt, Artificial sequence
  specific aptamers
ggaagguauggaaugugguauga

SEQ ID NO: 1227 - RNA, 23 nt, Artificial sequence
  specific aptamers
ggaagguauggaaugugguauua

SEQ ID NO: 1228 - RNA, 22 nt, Artificial sequence
  specific aptamers
ggaagguauggaaugugguaua

SEQ ID NO: 1229 - RNA, 23 nt, Artificial sequence
  specific aptamers
ggaagguauggcaugugguaaaa

SEQ ID NO: 1230 - RNA, 23 nt, Artificial sequence
  specific aptamers
ggaagguauggcaugugguaaca

SEQ ID NO: 1231 - RNA, 23 nt, Artificial sequence
  specific aptamers
ggaagguauggcaugugguaaga

SEQ ID NO: 1232 - RNA, 23 nt, Artificial sequence
  specific aptamers
ggaagguauggcaugugguaaua

SEQ ID NO: 1233 - RNA, 22 nt, Artificial sequence
  specific aptamers
ggaagguauggcaugugguaaa

SEQ ID NO: 1234 - RNA, 23 nt, Artificial sequence
  specific aptamers
ggaagguauggcaugugguacaa

SEQ ID NO: 1235 - RNA, 23 nt, Artificial sequence
  specific aptamers
ggaagguauggcaugugguacca

SEQ ID NO: 1236 - RNA, 23 nt, Artificial sequence
  specific aptamers
ggaagguauggcaugugguacga

SEQ ID NO: 1237 - RNA, 23 nt, Artificial sequence
  specific aptamers
ggaagguauggcaugugguacua

SEQ ID NO: 1238 - RNA, 22 nt, Artificial sequence
  specific aptamers
ggaagguauggcaugugguaca

SEQ ID NO: 1239 - RNA, 23 nt, Artificial sequence
  specific aptamers
ggaagguauggcaugugguagaa

SEQ ID NO: 1240 - RNA, 23 nt, Artificial sequence
  specific aptamers
ggaagguauggcaugugguagca

SEQ ID NO: 1241 - RNA, 23 nt, Artificial sequence
  specific aptamers
ggaagguauggcaugugguagga

SEQ ID NO: 1242 - RNA, 23 nt, Artificial sequence
  specific aptamers
ggaagguauggcaugugguagua

SEQ ID NO: 1243 - RNA, 22 nt, Artificial sequence
  specific aptamers
ggaagguauggcaugugguaga

SEQ ID NO: 1244 - RNA, 23 nt, Artificial sequence
  specific aptamers
ggaagguauggcaugugguauaa

SEQ ID NO: 1245 - RNA, 23 nt, Artificial sequence
  specific aptamers
ggaagguauggcaugugguauca

SEQ ID NO: 1246 - RNA, 23 nt, Artificial sequence
  specific aptamers
ggaagguauggcaugugguauga

SEQ ID NO: 1247 - RNA, 23 nt, Artificial sequence
  specific aptamers
ggaagguauggcaugugguauua

SEQ ID NO: 1248 - RNA, 22 nt, Artificial sequence
  specific aptamers
ggaagguauggcaugugguaua

SEQ ID NO: 1249 - RNA, 23 nt, Artificial sequence
  specific aptamers
ggaagguaugguaugugguaaaa

SEQ ID NO: 1250 - RNA, 23 nt, Artificial sequence
  specific aptamers
ggaagguaugguaugugguaaca

SEQ ID NO: 1251 - RNA, 23 nt, Artificial sequence
  specific aptamers
ggaagguaugguaugugguaaga

SEQ ID NO: 1252 - RNA, 23 nt, Artificial sequence
  specific aptamers
ggaagguaugguaugugguaaua

SEQ ID NO: 1253 - RNA, 22 nt, Artificial sequence
  specific aptamers
ggaagguaugguaugugguaaa

SEQ ID NO: 1254 - RNA, 23 nt, Artificial sequence
  specific aptamers
ggaagguaugguaugugguacaa

SEQ ID NO: 1255 - RNA, 23 nt, Artificial sequence
  specific aptamers
ggaagguaugguaugugguacca

SEQ ID NO: 1256 - RNA, 23 nt, Artificial sequence
  specific aptamers
ggaagguaugguaugugguacga

SEQ ID NO: 1257 - RNA, 23 nt, Artificial sequence
  specific aptamers
ggaagguaugguaugugguacua

SEQ ID NO: 1258 - RNA, 22 nt, Artificial sequence
  specific aptamers
ggaagguaugguaugugguaca

SEQ ID NO: 1259 - RNA, 23 nt, Artificial sequence
  specific aptamers
ggaagguaugguaugugguagaa

SEQ ID NO: 1260 - RNA, 23 nt, Artificial sequence
  specific aptamers
ggaagguaugguaugugguagca

SEQ ID NO: 1261 - RNA, 23 nt, Artificial sequence
  specific aptamers
ggaagguaugguaugugguagga

SEQ ID NO: 1262 - RNA, 23 nt, Artificial sequence
  specific aptamers
ggaagguaugguaugugguagua

SEQ ID NO: 1263 - RNA, 22 nt, Artificial sequence
  specific aptamers
ggaagguaugguaugugguaga

SEQ ID NO: 1264 - RNA, 23 nt, Artificial sequence
  specific aptamers
ggaagguaugguaugugguauaa

SEQ ID NO: 1265 - RNA, 23 nt, Artificial sequence
  specific aptamers
ggaagguaugguaugugguauca

SEQ ID NO: 1266 - RNA, 23 nt, Artificial sequence
  specific aptamers
ggaagguaugguaugugguauga

SEQ ID NO: 1267 - RNA, 23 nt, Artificial sequence
  specific aptamers
ggaagguaugguaugugguauua

SEQ ID NO: 1268 - RNA, 22 nt, Artificial sequence
  specific aptamers
ggaagguaugguaugugguaua

SEQ ID NO: 1269 - RNA, 23 nt, Artificial sequence
  specific aptamers
ggaagguuuggaaugugguaaaa

SEQ ID NO: 1270 - RNA, 23 nt, Artificial sequence
  specific aptamers
ggaagguuuggaaugugguaaca

SEQ ID NO: 1271 - RNA, 23 nt, Artificial sequence
  specific aptamers
ggaagguuuggaaugugguaaga

SEQ ID NO: 1272 - RNA, 23 nt, Artificial sequence
  specific aptamers
ggaagguuuggaaugugguaaua

SEQ ID NO: 1273 - RNA, 22 nt, Artificial sequence
  specific aptamers
ggaagguuuggaaugugguaaa

SEQ ID NO: 1274 - RNA, 23 nt, Artificial sequence
  specific aptamers
ggaagguuuggaaugugguacaa

SEQ ID NO: 1275 - RNA, 23 nt, Artificial sequence
  specific aptamers
ggaagguuuggaaugugguacca

SEQ ID NO: 1276 - RNA, 23 nt, Artificial sequence
  specific aptamers
ggaagguuuggaaugugguacga

SEQ ID NO: 1277 - RNA, 23 nt, Artificial sequence
  specific aptamers
ggaagguuuggaaugugguacua

SEQ ID NO: 1278 - RNA, 22 nt, Artificial sequence
  specific aptamers
ggaagguuuggaaugugguaca

SEQ ID NO: 1279 - RNA, 23 nt, Artificial sequence
  specific aptamers
ggaagguuuggaaugugguagaa

SEQ ID NO: 1280 - RNA, 23 nt, Artificial sequence
  specific aptamers
ggaagguuuggaaugugguagca

SEQ ID NO: 1281 - RNA, 23 nt, Artificial sequence
  specific aptamers
ggaagguuuggaaugugguagga

SEQ ID NO: 1282 - RNA, 23 nt, Artificial sequence
  specific aptamers
ggaagguuuggaaugugguagua

SEQ ID NO: 1283 - RNA, 22 nt, Artificial sequence
  specific aptamers
ggaagguuuggaaugugguaga

SEQ ID NO: 1284 - RNA, 23 nt, Artificial sequence
  specific aptamers
ggaagguuuggaaugugguauaa

SEQ ID NO: 1285 - RNA, 23 nt, Artificial sequence
  specific aptamers
ggaagguuuggaaugugguauca

SEQ ID NO: 1286 - RNA, 23 nt, Artificial sequence
  specific aptamers
ggaagguuuggaaugugguauga

SEQ ID NO: 1287 - RNA, 23 nt, Artificial sequence
  specific aptamers
ggaagguuuggaaugugguauua

SEQ ID NO: 1288 - RNA, 22 nt, Artificial sequence
  specific aptamers
ggaagguuuggaaugugguaua

SEQ ID NO: 1289 - RNA, 23 nt, Artificial sequence
  specific aptamers
ggaagguuuggcaugugguaaaa

SEQ ID NO: 1290 - RNA, 23 nt, Artificial sequence
  specific aptamers
ggaagguuuggcaugugguaaca

SEQ ID NO: 1291 - RNA, 23 nt, Artificial sequence
  specific aptamers
ggaagguuuggcaugugguaaga

SEQ ID NO: 1292 - RNA, 23 nt, Artificial sequence
  specific aptamers
ggaagguuuggcaugugguaaua

SEQ ID NO: 1293 - RNA, 22 nt, Artificial sequence
  specific aptamers
ggaagguuuggcaugugguaaa

SEQ ID NO: 1294 - RNA, 23 nt, Artificial sequence
  specific aptamers
ggaagguuuggcaugugguacaa

SEQ ID NO: 1295 - RNA, 23 nt, Artificial sequence
  specific aptamers
ggaagguuuggcaugugguacca

SEQ ID NO: 1296 - RNA, 23 nt, Artificial sequence
  specific aptamers
ggaagguuuggcaugugguacga

SEQ ID NO: 1297 - RNA, 23 nt, Artificial sequence
  specific aptamers
ggaagguuuggcaugugguacua

SEQ ID NO: 1298 - RNA, 22 nt, Artificial sequence
  specific aptamers
ggaagguuuggcaugugguaca

SEQ ID NO: 1299 - RNA, 23 nt, Artificial sequence
  specific aptamers
ggaagguuuggcaugugguagaa

SEQ ID NO: 1300 - RNA, 23 nt, Artificial sequence
  specific aptamers
ggaagguuuggcaugugguagca

SEQ ID NO: 1301 - RNA, 23 nt, Artificial sequence
  specific aptamers
ggaagguuuggcaugugguagga

SEQ ID NO: 1302 - RNA, 23 nt, Artificial sequence
  specific aptamers
ggaagguuuggcaugugguagua

SEQ ID NO: 1303 - RNA, 22 nt, Artificial sequence
  specific aptamers
ggaagguuuggcaugugguaga

SEQ ID NO: 1304 - RNA, 23 nt, Artificial sequence
  specific aptamers
ggaagguuuggcaugugguauaa

SEQ ID NO: 1305 - RNA, 23 nt, Artificial sequence
  specific aptamers
ggaagguuuggcaugugguauca

SEQ ID NO: 1306 - RNA, 23 nt, Artificial sequence
  specific aptamers
ggaagguuuggcaugugguauga

SEQ ID NO: 1307 - RNA, 23 nt, Artificial sequence
  specific aptamers
ggaagguuuggcaugugguauua

SEQ ID NO: 1308 - RNA, 22 nt, Artificial sequence
  specific aptamers
ggaagguuuggcaugugguaua

SEQ ID NO: 1309 - RNA, 23 nt, Artificial sequence
  specific aptamers
ggaagguuugguaugugguaaaa

SEQ ID NO: 1310 - RNA, 23 nt, Artificial sequence
  specific aptamers
ggaagguuugguaugugguaaca

SEQ ID NO: 1311 - RNA, 23 nt, Artificial sequence
  specific aptamers
ggaagguuugguaugugguaaga

SEQ ID NO: 1312 - RNA, 23 nt, Artificial sequence
  specific aptamers
ggaagguuugguaugugguaaua

SEQ ID NO: 1313 - RNA, 22 nt, Artificial sequence
  specific aptamers
ggaagguuugguaugugguaaa

SEQ ID NO: 1314 - RNA, 23 nt, Artificial sequence
  specific aptamers
ggaagguuugguaugugguacaa

SEQ ID NO: 1315 - RNA, 23 nt, Artificial sequence
  specific aptamers
ggaagguuugguaugugguacca

SEQ ID NO: 1316 - RNA, 23 nt, Artificial sequence
  specific aptamers
ggaagguuugguaugugguacga

SEQ ID NO: 1317 - RNA, 23 nt, Artificial sequence
  specific aptamers
ggaagguuugguaugugguacua

SEQ ID NO: 1318 - RNA, 22 nt, Artificial sequence
  specific aptamers
ggaagguuugguaugugguaca

SEQ ID NO: 1319 - RNA, 23 nt, Artificial sequence
  specific aptamers
ggaagguuugguaugugguagaa

SEQ ID NO: 1320 - RNA, 23 nt, Artificial sequence
  specific aptamers
ggaagguuugguaugugguagca

SEQ ID NO: 1321 - RNA, 23 nt, Artificial sequence
  specific aptamers
ggaagguuugguaugugguagga

SEQ ID NO: 1322 - RNA, 23 nt, Artificial sequence
  specific aptamers
ggaagguuugguaugugguagua

SEQ ID NO: 1323 - RNA, 22 nt, Artificial sequence
  specific aptamers
ggaagguuugguaugugguaga

SEQ ID NO: 1324 - RNA, 23 nt, Artificial sequence
  specific aptamers
ggaagguuugguaugugguauaa

SEQ ID NO: 1325 - RNA, 23 nt, Artificial sequence
  specific aptamers
ggaagguuugguaugugguauca

SEQ ID NO: 1326 - RNA, 23 nt, Artificial sequence
  specific aptamers
ggaagguuugguaugugguauga

SEQ ID NO: 1327 - RNA, 23 nt, Artificial sequence
  specific aptamers
ggaagguuugguaugugguauua

SEQ ID NO: 1328 - RNA, 22 nt, Artificial sequence
  specific aptamers
ggaagguuugguaugugguaua

SEQ ID NO: 1329 - RNA, 23 nt, Artificial sequence
  specific aptamers
gguagguauggaaugugguaaaa

SEQ ID NO: 1330 - RNA, 23 nt, Artificial sequence
  specific aptamers
gguagguauggaaugugguaaca

SEQ ID NO: 1331 - RNA, 23 nt, Artificial sequence
  specific aptamers
gguagguauggaaugugguaaga

SEQ ID NO: 1332 - RNA, 23 nt, Artificial sequence
  specific aptamers
gguagguauggaaugugguaaua

SEQ ID NO: 1333 - RNA, 22 nt, Artificial sequence
  specific aptamers
gguagguauggaaugugguaaa

SEQ ID NO: 1334 - RNA, 23 nt, Artificial sequence
  specific aptamers
gguagguauggaaugugguacaa

SEQ ID NO: 1335 - RNA, 23 nt, Artificial sequence
  specific aptamers
gguagguauggaaugugguacca

SEQ ID NO: 1336 - RNA, 23 nt, Artificial sequence
  specific aptamers
gguagguauggaaugugguacga

SEQ ID NO: 1337 - RNA, 23 nt, Artificial sequence
  specific aptamers
gguagguauggaaugugguacua

SEQ ID NO: 1338 - RNA, 22 nt, Artificial sequence
  specific aptamers
gguagguauggaaugugguaca

SEQ ID NO: 1339 - RNA, 23 nt, Artificial sequence
  specific aptamers
gguagguauggaaugugguagaa

SEQ ID NO: 1340 - RNA, 23 nt, Artificial sequence
  specific aptamers
gguagguauggaaugugguagca

SEQ ID NO: 1341 - RNA, 23 nt, Artificial sequence
  specific aptamers
gguagguauggaaugugguagga

SEQ ID NO: 1342 - RNA, 23 nt, Artificial sequence
  specific aptamers
gguagguauggaaugugguagua

SEQ ID NO: 1343 - RNA, 22 nt, Artificial sequence
  specific aptamers
gguagguauggaaugugguaga

SEQ ID NO: 1344 - RNA, 23 nt, Artificial sequence
  specific aptamers
gguagguauggaaugugguauaa

SEQ ID NO: 1345 - RNA, 23 nt, Artificial sequence
  specific aptamers
gguagguauggaaugugguauca

SEQ ID NO: 1346 - RNA, 23 nt, Artificial sequence
  specific aptamers
gguagguauggaaugugguauga

SEQ ID NO: 1347 - RNA, 23 nt, Artificial sequence
  specific aptamers
gguagguauggaaugugguauua

SEQ ID NO: 1348 - RNA, 22 nt, Artificial sequence
  specific aptamers
gguagguauggaaugugguaua

SEQ ID NO: 1349 - RNA, 23 nt, Artificial sequence
  specific aptamers
gguagguauggcaugugguaaaa

SEQ ID NO: 1350 - RNA, 23 nt, Artificial sequence
  specific aptamers
gguagguauggcaugugguaaca

SEQ ID NO: 1351 - RNA, 23 nt, Artificial sequence
  specific aptamers
gguagguauggcaugugguaaga

SEQ ID NO: 1352 - RNA, 23 nt, Artificial sequence
  specific aptamers
gguagguauggcaugugguaaua

SEQ ID NO: 1353 - RNA, 22 nt, Artificial sequence
  specific aptamers
gguagguauggcaugugguaaa

SEQ ID NO: 1354 - RNA, 23 nt, Artificial sequence
  specific aptamers
gguagguauggcaugugguacaa

SEQ ID NO: 1355 - RNA, 23 nt, Artificial sequence
  specific aptamers
gguagguauggcaugugguacca

SEQ ID NO: 1356 - RNA, 23 nt, Artificial sequence
  specific aptamers
gguagguauggcaugugguacga

SEQ ID NO: 1357 - RNA, 23 nt, Artificial sequence
  specific aptamers
gguagguauggcaugugguacua

SEQ ID NO: 1358 - RNA, 22 nt, Artificial sequence
  specific aptamers
gguagguauggcaugugguaca

SEQ ID NO: 1359 - RNA, 23 nt, Artificial sequence
  specific aptamers
gguagguauggcaugugguagaa

SEQ ID NO: 1360 - RNA, 23 nt, Artificial sequence
  specific aptamers
gguagguauggcaugugguagca

SEQ ID NO: 1361 - RNA, 23 nt, Artificial sequence
  specific aptamers
gguagguauggcaugugguagga

SEQ ID NO: 1362 - RNA, 23 nt, Artificial sequence
  specific aptamers
gguagguauggcaugugguagua

SEQ ID NO: 1363 - RNA, 22 nt, Artificial sequence
  specific aptamers
gguagguauggcaugugguaga

SEQ ID NO: 1364 - RNA, 23 nt, Artificial sequence
  specific aptamers
gguagguauggcaugugguauaa

SEQ ID NO: 1365 - RNA, 23 nt, Artificial sequence
  specific aptamers
gguagguauggcaugugguauca

SEQ ID NO: 1366 - RNA, 23 nt, Artificial sequence
  specific aptamers
gguagguauggcaugugguauga

SEQ ID NO: 1367 - RNA, 23 nt, Artificial sequence
  specific aptamers
gguagguauggcaugugguauua

SEQ ID NO: 1368 - RNA, 22 nt, Artificial sequence
  specific aptamers
gguagguauggcaugugguaua

SEQ ID NO: 1369 - RNA, 23 nt, Artificial sequence
  specific aptamers
gguagguaugguaugugguaaaa

SEQ ID NO: 1370 - RNA, 23 nt, Artificial sequence
  specific aptamers
gguagguaugguaugugguaaca

SEQ ID NO: 1371 - RNA, 23 nt, Artificial sequence
  specific aptamers
gguagguaugguaugugguaaga

SEQ ID NO: 1372 - RNA, 23 nt, Artificial sequence
  specific aptamers
gguagguaugguaugugguaaua

SEQ ID NO: 1373 - RNA, 22 nt, Artificial sequence
  specific aptamers
gguagguaugguaugugguaaa

SEQ ID NO: 1374 - RNA, 23 nt, Artificial sequence
  specific aptamers
gguagguaugguaugugguacaa

SEQ ID NO: 1375 - RNA, 23 nt, Artificial sequence
  specific aptamers
gguagguaugguaugugguacca

SEQ ID NO: 1376 - RNA, 23 nt, Artificial sequence
  specific aptamers
gguagguaugguaugugguacga

SEQ ID NO: 1377 - RNA, 23 nt, Artificial sequence
  specific aptamers
gguagguaugguaugugguacua

SEQ ID NO: 1378 - RNA, 22 nt, Artificial sequence
  specific aptamers
gguagguaugguaugugguaca

SEQ ID NO: 1379 - RNA, 23 nt, Artificial sequence
  specific aptamers
gguagguaugguaugugguagaa

SEQ ID NO: 1380 - RNA, 23 nt, Artificial sequence
  specific aptamers
gguagguaugguaugugguagca

SEQ ID NO: 1381 - RNA, 23 nt, Artificial sequence
  specific aptamers
gguagguaugguaugugguagga

SEQ ID NO: 1382 - RNA, 23 nt, Artificial sequence
  specific aptamers
gguagguaugguaugugguagua

SEQ ID NO: 1383 - RNA, 22 nt, Artificial sequence
  specific aptamers
gguagguaugguaugugguaga

SEQ ID NO: 1384 - RNA, 23 nt, Artificial sequence
  specific aptamers
gguagguaugguaugugguauaa

SEQ ID NO: 1385 - RNA, 23 nt, Artificial sequence
  specific aptamers
gguagguaugguaugugguauca

SEQ ID NO: 1386 - RNA, 23 nt, Artificial sequence
  specific aptamers
gguagguaugguaugugguauga

SEQ ID NO: 1387 - RNA, 23 nt, Artificial sequence
  specific aptamers
gguagguaugguaugugguauua

SEQ ID NO: 1388 - RNA, 22 nt, Artificial sequence
  specific aptamers
gguagguaugguaugugguaua

SEQ ID NO: 1389 - RNA, 23 nt, Artificial sequence
  specific aptamers
gguagguuuggaaugugguaaaa

SEQ ID NO: 1390 - RNA, 23 nt, Artificial sequence
  specific aptamers
gguagguuuggaaugugguaaca

SEQ ID NO: 1391 - RNA, 23 nt, Artificial sequence
  specific aptamers
gguagguuuggaaugugguaaga

SEQ ID NO: 1392 - RNA, 23 nt, Artificial sequence
  specific aptamers
gguagguuuggaaugugguaaua

SEQ ID NO: 1393 - RNA, 22 nt, Artificial sequence
  specific aptamers
gguagguuuggaaugugguaaa

SEQ ID NO: 1394 - RNA, 23 nt, Artificial sequence
  specific aptamers
gguagguuuggaaugugguacaa

SEQ ID NO: 1395 - RNA, 23 nt, Artificial sequence
  specific aptamers
gguagguuuggaaugugguacca

SEQ ID NO: 1396 - RNA, 23 nt, Artificial sequence
  specific aptamers
gguagguuuggaaugugguacga

SEQ ID NO: 1397 - RNA, 23 nt, Artificial sequence
  specific aptamers
gguagguuuggaaugugguacua

SEQ ID NO: 1398 - RNA, 22 nt, Artificial sequence
  specific aptamers
gguagguuuggaaugugguaca

SEQ ID NO: 1399 - RNA, 23 nt, Artificial sequence
  specific aptamers
gguagguuuggaaugugguagaa

SEQ ID NO: 1400 - RNA, 23 nt, Artificial sequence
  specific aptamers
gguagguuuggaaugugguagca

SEQ ID NO: 1401 - RNA, 23 nt, Artificial sequence
  specific aptamers
gguagguuuggaaugugguagga

SEQ ID NO: 1402 - RNA, 23 nt, Artificial sequence
  specific aptamers
gguagguuuggaaugugguagua

SEQ ID NO: 1403 - RNA, 22 nt, Artificial sequence
  specific aptamers
gguagguuuggaaugugguaga

SEQ ID NO: 1404 - RNA, 23 nt, Artificial sequence
  specific aptamers
gguagguuuggaaugugguauaa

SEQ ID NO: 1405 - RNA, 23 nt, Artificial sequence
  specific aptamers
gguagguuuggaaugugguauca

SEQ ID NO: 1406 - RNA, 23 nt, Artificial sequence
  specific aptamers
gguagguuuggaaugugguauga

SEQ ID NO: 1407 - RNA, 23 nt, Artificial sequence
  specific aptamers
gguagguuuggaaugugguauua

SEQ ID NO: 1408 - RNA, 22 nt, Artificial sequence
  specific aptamers
gguagguuuggaaugugguaua

SEQ ID NO: 1409 - RNA, 23 nt, Artificial sequence
  specific aptamers
gguagguuuggcaugugguaaaa

SEQ ID NO: 1410 - RNA, 23 nt, Artificial sequence
  specific aptamers
gguagguuuggcaugugguaaca

SEQ ID NO: 1411 - RNA, 23 nt, Artificial sequence
  specific aptamers
gguagguuuggcaugugguaaga

SEQ ID NO: 1412 - RNA, 23 nt, Artificial sequence
  specific aptamers
gguagguuuggcaugugguaaua

SEQ ID NO: 1413 - RNA, 22 nt, Artificial sequence
  specific aptamers
gguagguuuggcaugugguaaa

SEQ ID NO: 1414 - RNA, 23 nt, Artificial sequence
  specific aptamers
gguagguuuggcaugugguacaa

SEQ ID NO: 1415 - RNA, 23 nt, Artificial sequence
  specific aptamers
gguagguuuggcaugugguacca

SEQ ID NO: 1416 - RNA, 23 nt, Artificial sequence
  specific aptamers
gguagguuuggcaugugguacga

SEQ ID NO: 1417 - RNA, 23 nt, Artificial sequence
  specific aptamers
gguagguuuggcaugugguacua

SEQ ID NO: 1418 - RNA, 22 nt, Artificial sequence
  specific aptamers
gguagguuuggcaugugguaca

SEQ ID NO: 1419 - RNA, 23 nt, Artificial sequence
  specific aptamers
gguagguuuggcaugugguagaa

SEQ ID NO: 1420 - RNA, 23 nt, Artificial sequence
  specific aptamers
gguagguuuggcaugugguagca

SEQ ID NO: 1421 - RNA, 23 nt, Artificial sequence
  specific aptamers
gguagguuuggcaugugguagga

SEQ ID NO: 1422 - RNA, 23 nt, Artificial sequence
  specific aptamers
gguagguuuggcaugugguagua

SEQ ID NO: 1423 - RNA, 22 nt, Artificial sequence
  specific aptamers
gguagguuuggcaugugguaga

SEQ ID NO: 1424 - RNA, 23 nt, Artificial sequence
  specific aptamers
gguagguuuggcaugugguauaa

SEQ ID NO: 1425 - RNA, 23 nt, Artificial sequence
  specific aptamers
gguagguuuggcaugugguauca

SEQ ID NO: 1426 - RNA, 23 nt, Artificial sequence
  specific aptamers
gguagguuuggcaugugguauga

SEQ ID NO: 1427 - RNA, 23 nt, Artificial sequence
  specific aptamers
gguagguuuggcaugugguauua

SEQ ID NO: 1428 - RNA, 22 nt, Artificial sequence
  specific aptamers
gguagguuuggcaugugguaua

SEQ ID NO: 1429 - RNA, 23 nt, Artificial sequence
  specific aptamers
gguagguuugguaugugguaaaa

SEQ ID NO: 1430 - RNA, 23 nt, Artificial sequence
  specific aptamers
gguagguuugguaugugguaaca

SEQ ID NO: 1431 - RNA, 23 nt, Artificial sequence
  specific aptamers
gguagguuugguaugugguaaga

SEQ ID NO: 1432 - RNA, 23 nt, Artificial sequence
  specific aptamers
gguagguuugguaugugguaaua

SEQ ID NO: 1433 - RNA, 22 nt, Artificial sequence
  specific aptamers
gguagguuugguaugugguaaa

SEQ ID NO: 1434 - RNA, 23 nt, Artificial sequence
  specific aptamers
gguagguuugguaugugguacaa

SEQ ID NO: 1435 - RNA, 23 nt, Artificial sequence
  specific aptamers
gguagguuugguaugugguacca

SEQ ID NO: 1436 - RNA, 23 nt, Artificial sequence
  specific aptamers
gguagguuugguaugugguacga

SEQ ID NO: 1437 - RNA, 23 nt, Artificial sequence
  specific aptamers
gguagguuugguaugugguacua

SEQ ID NO: 1438 - RNA, 22 nt, Artificial sequence
  specific aptamers
gguagguuugguaugugguaca

SEQ ID NO: 1439 - RNA, 23 nt, Artificial sequence
  specific aptamers
gguagguuugguaugugguagaa

SEQ ID NO: 1440 - RNA, 23 nt, Artificial sequence
  specific aptamers
gguagguuugguaugugguagca

SEQ ID NO: 1441 - RNA, 23 nt, Artificial sequence
  specific aptamers
gguagguuugguaugugguagga

SEQ ID NO: 1442 - RNA, 23 nt, Artificial sequence
  specific aptamers
gguagguuugguaugugguagua

SEQ ID NO: 1443 - RNA, 22 nt, Artificial sequence
  specific aptamers
gguagguuugguaugugguaga

SEQ ID NO: 1444 - RNA, 23 nt, Artificial sequence
  specific aptamers
gguagguuugguaugugguauaa

SEQ ID NO: 1445 - RNA, 23 nt, Artificial sequence
  specific aptamers
gguagguuugguaugugguauca

SEQ ID NO: 1446 - RNA, 23 nt, Artificial sequence
  specific aptamers
gguagguuugguaugugguauga

SEQ ID NO: 1447 - RNA, 23 nt, Artificial sequence
  specific aptamers
gguagguuugguaugugguauua

SEQ ID NO: 1448 - RNA, 22 nt, Artificial sequence
  specific aptamers
gguagguuugguaugugguaua

SEQ ID NO: 1449 - RNA, 23 nt, Artificial sequence
  specific aptamers
ggaagguauggaaugugguaaau

SEQ ID NO: 1450 - RNA, 23 nt, Artificial sequence
  specific aptamers
ggaagguauggaaugugguaacu

SEQ ID NO: 1451 - RNA, 23 nt, Artificial sequence
  specific aptamers
ggaagguauggaaugugguaagu

SEQ ID NO: 1452 - RNA, 23 nt, Artificial sequence
  specific aptamers
ggaagguauggaaugugguaauu

SEQ ID NO: 1453 - RNA, 22 nt, Artificial sequence
  specific aptamers
ggaagguauggaaugugguaau

SEQ ID NO: 1454 - RNA, 23 nt, Artificial sequence
  specific aptamers
ggaagguauggaaugugguacau

SEQ ID NO: 1455 - RNA, 23 nt, Artificial sequence
  specific aptamers
ggaagguauggaaugugguaccu

SEQ ID NO: 1456 - RNA, 23 nt, Artificial sequence
  specific aptamers
ggaagguauggaaugugguacgu

SEQ ID NO: 1457 - RNA, 23 nt, Artificial sequence
  specific aptamers
ggaagguauggaaugugguacuu

SEQ ID NO: 1458 - RNA, 22 nt, Artificial sequence
  specific aptamers
ggaagguauggaaugugguacu

SEQ ID NO: 1459 - RNA, 23 nt, Artificial sequence
  specific aptamers
ggaagguauggaaugugguagau

SEQ ID NO: 1460 - RNA, 23 nt, Artificial sequence
  specific aptamers
ggaagguauggaaugugguagcu

SEQ ID NO: 1461 - RNA, 23 nt, Artificial sequence
  specific aptamers
ggaagguauggaaugugguaggu

SEQ ID NO: 1462 - RNA, 23 nt, Artificial sequence
  specific aptamers
ggaagguauggaaugugguaguu

SEQ ID NO: 1463 - RNA, 22 nt, Artificial sequence
  specific aptamers
ggaagguauggaaugugguagu

SEQ ID NO: 1464 - RNA, 23 nt, Artificial sequence
  specific aptamers
ggaagguauggaaugugguauau

SEQ ID NO: 1465 - RNA, 23 nt, Artificial sequence
  specific aptamers
ggaagguauggaaugugguaucu

SEQ ID NO: 1466 - RNA, 23 nt, Artificial sequence
  specific aptamers
ggaagguauggaaugugguaugu

SEQ ID NO: 1467 - RNA, 23 nt, Artificial sequence
  specific aptamers
ggaagguauggaaugugguauuu

SEQ ID NO: 1468 - RNA, 22 nt, Artificial sequence
  specific aptamers
ggaagguauggaaugugguauu

SEQ ID NO: 1469 - RNA, 23 nt, Artificial sequence
  specific aptamers
ggaagguauggcaugugguaaau

SEQ ID NO: 1470 - RNA, 23 nt, Artificial sequence
  specific aptamers
ggaagguauggcaugugguaacu

SEQ ID NO: 1471 - RNA, 23 nt, Artificial sequence
  specific aptamers
ggaagguauggcaugugguaagu

SEQ ID NO: 1472 - RNA, 23 nt, Artificial sequence
  specific aptamers
ggaagguauggcaugugguaauu

SEQ ID NO: 1473 - RNA, 22 nt, Artificial sequence
  specific aptamers
ggaagguauggcaugugguaau

SEQ ID NO: 1474 - RNA, 23 nt, Artificial sequence
  specific aptamers
ggaagguauggcaugugguacau

SEQ ID NO: 1475 - RNA, 23 nt, Artificial sequence
  specific aptamers
ggaagguauggcaugugguaccu

SEQ ID NO: 1476 - RNA, 23 nt, Artificial sequence
  specific aptamers
ggaagguauggcaugugguacgu

SEQ ID NO: 1477 - RNA, 23 nt, Artificial sequence
  specific aptamers
ggaagguauggcaugugguacuu

SEQ ID NO: 1478 - RNA, 22 nt, Artificial sequence
  specific aptamers
ggaagguauggcaugugguacu

SEQ ID NO: 1479 - RNA, 23 nt, Artificial sequence
  specific aptamers
ggaagguauggcaugugguagau

SEQ ID NO: 1480 - RNA, 23 nt, Artificial sequence
  specific aptamers
ggaagguauggcaugugguagcu

SEQ ID NO: 1481 - RNA, 23 nt, Artificial sequence
  specific aptamers
ggaagguauggcaugugguaggu

SEQ ID NO: 1482 - RNA, 23 nt, Artificial sequence
  specific aptamers
ggaagguauggcaugugguaguu

SEQ ID NO: 1483 - RNA, 22 nt, Artificial sequence
  specific aptamers
ggaagguauggcaugugguagu

SEQ ID NO: 1484 - RNA, 23 nt, Artificial sequence
  specific aptamers
ggaagguauggcaugugguauau

SEQ ID NO: 1485 - RNA, 23 nt, Artificial sequence
  specific aptamers
ggaagguauggcaugugguaucu

SEQ ID NO: 1486 - RNA, 23 nt, Artificial sequence
  specific aptamers
ggaagguauggcaugugguaugu

SEQ ID NO: 1487 - RNA, 23 nt, Artificial sequence
  specific aptamers
ggaagguauggcaugugguauuu

SEQ ID NO: 1488 - RNA, 22 nt, Artificial sequence
  specific aptamers
ggaagguauggcaugugguauu

SEQ ID NO: 1489 - RNA, 23 nt, Artificial sequence
  specific aptamers
ggaagguaugguaugugguaaau

SEQ ID NO: 1490 - RNA, 23 nt, Artificial sequence
  specific aptamers
ggaagguaugguaugugguaacu

SEQ ID NO: 1491 - RNA, 23 nt, Artificial sequence
  specific aptamers
ggaagguaugguaugugguaagu

SEQ ID NO: 1492 - RNA, 23 nt, Artificial sequence
  specific aptamers
ggaagguaugguaugugguaauu

SEQ ID NO: 1493 - RNA, 22 nt, Artificial sequence
  specific aptamers
ggaagguaugguaugugguaau

SEQ ID NO: 1494 - RNA, 23 nt, Artificial sequence
  specific aptamers
ggaagguaugguaugugguacau

SEQ ID NO: 1495 - RNA, 23 nt, Artificial sequence
  specific aptamers
ggaagguaugguaugugguaccu

SEQ ID NO: 1496 - RNA, 23 nt, Artificial sequence
  specific aptamers
ggaagguaugguaugugguacgu

SEQ ID NO: 1497 - RNA, 23 nt, Artificial sequence
  specific aptamers
ggaagguaugguaugugguacuu

SEQ ID NO: 1498 - RNA, 22 nt, Artificial sequence
  specific aptamers
ggaagguaugguaugugguacu

SEQ ID NO: 1499 - RNA, 23 nt, Artificial sequence
  specific aptamers
ggaagguaugguaugugguagau

SEQ ID NO: 1500 - RNA, 23 nt, Artificial sequence
  specific aptamers
ggaagguaugguaugugguagcu

SEQ ID NO: 1501 - RNA, 23 nt, Artificial sequence
  specific aptamers
ggaagguaugguaugugguaggu

SEQ ID NO: 1502 - RNA, 23 nt, Artificial sequence
  specific aptamers
ggaagguaugguaugugguaguu

SEQ ID NO: 1503 - RNA, 22 nt, Artificial sequence
  specific aptamers
ggaagguaugguaugugguagu

SEQ ID NO: 1504 - RNA, 23 nt, Artificial sequence
  specific aptamers
ggaagguaugguaugugguauau

SEQ ID NO: 1505 - RNA, 23 nt, Artificial sequence
  specific aptamers
ggaagguaugguaugugguaucu

SEQ ID NO: 1506 - RNA, 23 nt, Artificial sequence
  specific aptamers
ggaagguaugguaugugguaugu

SEQ ID NO: 1507 - RNA, 23 nt, Artificial sequence
  specific aptamers
ggaagguaugguaugugguauuu

SEQ ID NO: 1508 - RNA, 22 nt, Artificial sequence
  specific aptamers
ggaagguaugguaugugguauu

SEQ ID NO: 1509 - RNA, 23 nt, Artificial sequence
  specific aptamers
ggaagguuuggaaugugguaaau

SEQ ID NO: 1510 - RNA, 23 nt, Artificial sequence
  specific aptamers
ggaagguuuggaaugugguaacu

SEQ ID NO: 1511 - RNA, 23 nt, Artificial sequence
  specific aptamers
ggaagguuuggaaugugguaagu

SEQ ID NO: 1512 - RNA, 23 nt, Artificial sequence
  specific aptamers
ggaagguuuggaaugugguaauu

SEQ ID NO: 1513 - RNA, 22 nt, Artificial sequence
  specific aptamers
ggaagguuuggaaugugguaau

SEQ ID NO: 1514 - RNA, 23 nt, Artificial sequence
  specific aptamers
ggaagguuuggaaugugguacau

SEQ ID NO: 1515 - RNA, 23 nt, Artificial sequence
  specific aptamers
ggaagguuuggaaugugguaccu

SEQ ID NO: 1516 - RNA, 23 nt, Artificial sequence
  specific aptamers
ggaagguuuggaaugugguacgu

SEQ ID NO: 1517 - RNA, 23 nt, Artificial sequence
  specific aptamers
ggaagguuuggaaugugguacuu

SEQ ID NO: 1518 - RNA, 22 nt, Artificial sequence
  specific aptamers
ggaagguuuggaaugugguacu

SEQ ID NO: 1519 - RNA, 23 nt, Artificial sequence
  specific aptamers
ggaagguuuggaaugugguagau

SEQ ID NO: 1520 - RNA, 23 nt, Artificial sequence
  specific aptamers
ggaagguuuggaaugugguagcu

SEQ ID NO: 1521 - RNA, 23 nt, Artificial sequence
  specific aptamers
ggaagguuuggaaugugguaggu

SEQ ID NO: 1522 - RNA, 23 nt, Artificial sequence
  specific aptamers
ggaagguuuggaaugugguaguu

SEQ ID NO: 1523 - RNA, 22 nt, Artificial sequence
  specific aptamers
ggaagguuuggaaugugguagu

SEQ ID NO: 1524 - RNA, 23 nt, Artificial sequence
  specific aptamers
ggaagguuuggaaugugguauau

SEQ ID NO: 1525 - RNA, 23 nt, Artificial sequence
  specific aptamers
ggaagguuuggaaugugguaucu

SEQ ID NO: 1526 - RNA, 23 nt, Artificial sequence
  specific aptamers
ggaagguuuggaaugugguaugu

SEQ ID NO: 1527 - RNA, 23 nt, Artificial sequence
  specific aptamers
ggaagguuuggaaugugguauuu

SEQ ID NO: 1528 - RNA, 22 nt, Artificial sequence
  specific aptamers
ggaagguuuggaaugugguauu

SEQ ID NO: 1529 - RNA, 23 nt, Artificial sequence
  specific aptamers
ggaagguuuggcaugugguaaau

SEQ ID NO: 1530 - RNA, 23 nt, Artificial sequence
  specific aptamers
ggaagguuuggcaugugguaacu

SEQ ID NO: 1531 - RNA, 23 nt, Artificial sequence
  specific aptamers
ggaagguuuggcaugugguaagu

SEQ ID NO: 1532 - RNA, 23 nt, Artificial sequence
  specific aptamers
ggaagguuuggcaugugguaauu

SEQ ID NO: 1533 - RNA, 22 nt, Artificial sequence
  specific aptamers
ggaagguuuggcaugugguaau

SEQ ID NO: 1534 - RNA, 23 nt, Artificial sequence
  specific aptamers
ggaagguuuggcaugugguacau

SEQ ID NO: 1535 - RNA, 23 nt, Artificial sequence
  specific aptamers
ggaagguuuggcaugugguaccu

SEQ ID NO: 1536 - RNA, 23 nt, Artificial sequence
  specific aptamers
ggaagguuuggcaugugguacgu

SEQ ID NO: 1537 - RNA, 23 nt, Artificial sequence
  specific aptamers
ggaagguuuggcaugugguacuu

SEQ ID NO: 1538 - RNA, 22 nt, Artificial sequence
  specific aptamers
ggaagguuuggcaugugguacu

SEQ ID NO: 1539 - RNA, 23 nt, Artificial sequence
  specific aptamers
ggaagguuuggcaugugguagau

SEQ ID NO: 1540 - RNA, 23 nt, Artificial sequence
  specific aptamers
ggaagguuuggcaugugguagcu

SEQ ID NO: 1541 - RNA, 23 nt, Artificial sequence
  specific aptamers
ggaagguuuggcaugugguaggu

SEQ ID NO: 1542 - RNA, 23 nt, Artificial sequence
  specific aptamers
ggaagguuuggcaugugguaguu

SEQ ID NO: 1543 - RNA, 22 nt, Artificial sequence
  specific aptamers
ggaagguuuggcaugugguagu

SEQ ID NO: 1544 - RNA, 23 nt, Artificial sequence
  specific aptamers
ggaagguuuggcaugugguauau

SEQ ID NO: 1545 - RNA, 23 nt, Artificial sequence
  specific aptamers
ggaagguuuggcaugugguaucu

SEQ ID NO: 1546 - RNA, 23 nt, Artificial sequence
  specific aptamers
ggaagguuuggcaugugguaugu

SEQ ID NO: 1547 - RNA, 23 nt, Artificial sequence
  specific aptamers
ggaagguuuggcaugugguauuu

SEQ ID NO: 1548 - RNA, 22 nt, Artificial sequence
  specific aptamers
ggaagguuuggcaugugguauu

SEQ ID NO: 1549 - RNA, 23 nt, Artificial sequence
  specific aptamers
ggaagguuugguaugugguaaau

SEQ ID NO: 1550 - RNA, 23 nt, Artificial sequence
  specific aptamers
ggaagguuugguaugugguaacu

SEQ ID NO: 1551 - RNA, 23 nt, Artificial sequence
  specific aptamers
ggaagguuugguaugugguaagu

SEQ ID NO: 1552 - RNA, 23 nt, Artificial sequence
  specific aptamers
ggaagguuugguaugugguaauu

SEQ ID NO: 1553 - RNA, 22 nt, Artificial sequence
  specific aptamers
ggaagguuugguaugugguaau

SEQ ID NO: 1554 - RNA, 23 nt, Artificial sequence
  specific aptamers
ggaagguuugguaugugguacau

SEQ ID NO: 1555 - RNA, 23 nt, Artificial sequence
  specific aptamers
ggaagguuugguaugugguaccu

SEQ ID NO: 1556 - RNA, 23 nt, Artificial sequence
  specific aptamers
ggaagguuugguaugugguacgu

SEQ ID NO: 1557 - RNA, 23 nt, Artificial sequence
  specific aptamers
ggaagguuugguaugugguacuu

SEQ ID NO: 1558 - RNA, 22 nt, Artificial sequence
  specific aptamers
ggaagguuugguaugugguacu

SEQ ID NO: 1559 - RNA, 23 nt, Artificial sequence
  specific aptamers
ggaagguuugguaugugguagau

SEQ ID NO: 1560 - RNA, 23 nt, Artificial sequence
  specific aptamers
ggaagguuugguaugugguagcu

SEQ ID NO: 1561 - RNA, 23 nt, Artificial sequence
  specific aptamers
ggaagguuugguaugugguaggu

SEQ ID NO: 1562 - RNA, 23 nt, Artificial sequence
  specific aptamers
ggaagguuugguaugugguaguu

SEQ ID NO: 1563 - RNA, 22 nt, Artificial sequence
  specific aptamers
ggaagguuugguaugugguagu

SEQ ID NO: 1564 - RNA, 23 nt, Artificial sequence
  specific aptamers
ggaagguuugguaugugguauau

SEQ ID NO: 1565 - RNA, 23 nt, Artificial sequence
  specific aptamers
ggaagguuugguaugugguaucu

SEQ ID NO: 1566 - RNA, 23 nt, Artificial sequence
  specific aptamers
ggaagguuugguaugugguaugu

SEQ ID NO: 1567 - RNA, 23 nt, Artificial sequence
  specific aptamers
ggaagguuugguaugugguauuu

SEQ ID NO: 1568 - RNA, 22 nt, Artificial sequence
  specific aptamers
ggaagguuugguaugugguauu

SEQ ID NO: 1569 - RNA, 23 nt, Artificial sequence
  specific aptamers
gguagguauggaaugugguaaau

SEQ ID NO: 1570 - RNA, 23 nt, Artificial sequence
  specific aptamers
gguagguauggaaugugguaacu

SEQ ID NO: 1571 - RNA, 23 nt, Artificial sequence
  specific aptamers
gguagguauggaaugugguaagu

SEQ ID NO: 1572 - RNA, 23 nt, Artificial sequence
  specific aptamers
gguagguauggaaugugguaauu

SEQ ID NO: 1573 - RNA, 22 nt, Artificial sequence
  specific aptamers
gguagguauggaaugugguaau

SEQ ID NO: 1574 - RNA, 23 nt, Artificial sequence
  specific aptamers
gguagguauggaaugugguacau

SEQ ID NO: 1575 - RNA, 23 nt, Artificial sequence
  specific aptamers
gguagguauggaaugugguaccu

SEQ ID NO: 1576 - RNA, 23 nt, Artificial sequence
  specific aptamers
gguagguauggaaugugguacgu

SEQ ID NO: 1577 - RNA, 23 nt, Artificial sequence
  specific aptamers
gguagguauggaaugugguacuu

SEQ ID NO: 1578 - RNA, 22 nt, Artificial sequence
  specific aptamers
gguagguauggaaugugguacu

SEQ ID NO: 1579 - RNA, 23 nt, Artificial sequence
  specific aptamers
gguagguauggaaugugguagau

SEQ ID NO: 1580 - RNA, 23 nt, Artificial sequence
  specific aptamers
gguagguauggaaugugguagcu

SEQ ID NO: 1581 - RNA, 23 nt, Artificial sequence
  specific aptamers
gguagguauggaaugugguaggu

SEQ ID NO: 1582 - RNA, 23 nt, Artificial sequence
  specific aptamers
gguagguauggaaugugguaguu

SEQ ID NO: 1583 - RNA, 22 nt, Artificial sequence
  specific aptamers
gguagguauggaaugugguagu

SEQ ID NO: 1584 - RNA, 23 nt, Artificial sequence
  specific aptamers
gguagguauggaaugugguauau

SEQ ID NO: 1585 - RNA, 23 nt, Artificial sequence
  specific aptamers
gguagguauggaaugugguaucu

SEQ ID NO: 1586 - RNA, 23 nt, Artificial sequence
  specific aptamers
gguagguauggaaugugguaugu

SEQ ID NO: 1587 - RNA, 23 nt, Artificial sequence
  specific aptamers
gguagguauggaaugugguauuu

SEQ ID NO: 1588 - RNA, 22 nt, Artificial sequence
  specific aptamers
gguagguauggaaugugguauu

SEQ ID NO: 1589 - RNA, 23 nt, Artificial sequence
  specific aptamers
gguagguauggcaugugguaaau

SEQ ID NO: 1590 - RNA, 23 nt, Artificial sequence
  specific aptamers
gguagguauggcaugugguaacu

SEQ ID NO: 1591 - RNA, 23 nt, Artificial sequence
  specific aptamers
gguagguauggcaugugguaagu

SEQ ID NO: 1592 - RNA, 23 nt, Artificial sequence
  specific aptamers
gguagguauggcaugugguaauu

SEQ ID NO: 1593 - RNA, 22 nt, Artificial sequence
  specific aptamers
gguagguauggcaugugguaau

SEQ ID NO: 1594 - RNA, 23 nt, Artificial sequence
  specific aptamers
gguagguauggcaugugguacau

SEQ ID NO: 1595 - RNA, 23 nt, Artificial sequence
  specific aptamers
gguagguauggcaugugguaccu

SEQ ID NO: 1596 - RNA, 23 nt, Artificial sequence
  specific aptamers
gguagguauggcaugugguacgu

SEQ ID NO: 1597 - RNA, 23 nt, Artificial sequence
  specific aptamers
gguagguauggcaugugguacuu

SEQ ID NO: 1598 - RNA, 22 nt, Artificial sequence
  specific aptamers
gguagguauggcaugugguacu

SEQ ID NO: 1599 - RNA, 23 nt, Artificial sequence
  specific aptamers
gguagguauggcaugugguagau

SEQ ID NO: 1600 - RNA, 23 nt, Artificial sequence
  specific aptamers
gguagguauggcaugugguagcu

SEQ ID NO: 1601 - RNA, 23 nt, Artificial sequence
  specific aptamers
gguagguauggcaugugguaggu

SEQ ID NO: 1602 - RNA, 23 nt, Artificial sequence
  specific aptamers
gguagguauggcaugugguaguu

SEQ ID NO: 1603 - RNA, 22 nt, Artificial sequence
  specific aptamers
gguagguauggcaugugguagu

SEQ ID NO: 1604 - RNA, 23 nt, Artificial sequence
  specific aptamers
gguagguauggcaugugguauau

SEQ ID NO: 1605 - RNA, 23 nt, Artificial sequence
  specific aptamers
gguagguauggcaugugguaucu

SEQ ID NO: 1606 - RNA, 23 nt, Artificial sequence
  specific aptamers
gguagguauggcaugugguaugu

SEQ ID NO: 1607 - RNA, 23 nt, Artificial sequence
  specific aptamers
gguagguauggcaugugguauuu

SEQ ID NO: 1608 - RNA, 22 nt, Artificial sequence
  specific aptamers
gguagguauggcaugugguauu

SEQ ID NO: 1609 - RNA, 23 nt, Artificial sequence
  specific aptamers
gguagguaugguaugugguaaau

SEQ ID NO: 1610 - RNA, 23 nt, Artificial sequence
  specific aptamers
gguagguaugguaugugguaacu

SEQ ID NO: 1611 - RNA, 23 nt, Artificial sequence
  specific aptamers
gguagguaugguaugugguaagu

SEQ ID NO: 1612 - RNA, 23 nt, Artificial sequence
  specific aptamers
gguagguaugguaugugguaauu

SEQ ID NO: 1613 - RNA, 22 nt, Artificial sequence
  specific aptamers
gguagguaugguaugugguaau

SEQ ID NO: 1614 - RNA, 23 nt, Artificial sequence
  specific aptamers
gguagguaugguaugugguacau

SEQ ID NO: 1615 - RNA, 23 nt, Artificial sequence
  specific aptamers
gguagguaugguaugugguaccu

SEQ ID NO: 1616 - RNA, 23 nt, Artificial sequence
  specific aptamers
gguagguaugguaugugguacgu

SEQ ID NO: 1617 - RNA, 23 nt, Artificial sequence
  specific aptamers
gguagguaugguaugugguacuu

SEQ ID NO: 1618 - RNA, 22 nt, Artificial sequence
  specific aptamers
gguagguaugguaugugguacu

SEQ ID NO: 1619 - RNA, 23 nt, Artificial sequence
  specific aptamers
gguagguaugguaugugguagau

SEQ ID NO: 1620 - RNA, 23 nt, Artificial sequence
  specific aptamers
gguagguaugguaugugguagcu

SEQ ID NO: 1621 - RNA, 23 nt, Artificial sequence
  specific aptamers
gguagguaugguaugugguaggu

SEQ ID NO: 1622 - RNA, 23 nt, Artificial sequence
  specific aptamers
gguagguaugguaugugguaguu

SEQ ID NO: 1623 - RNA, 22 nt, Artificial sequence
  specific aptamers
gguagguaugguaugugguagu

SEQ ID NO: 1624 - RNA, 23 nt, Artificial sequence
  specific aptamers
gguagguaugguaugugguauau

SEQ ID NO: 1625 - RNA, 23 nt, Artificial sequence
  specific aptamers
gguagguaugguaugugguaucu

SEQ ID NO: 1626 - RNA, 23 nt, Artificial sequence
  specific aptamers
gguagguaugguaugugguaugu

SEQ ID NO: 1627 - RNA, 23 nt, Artificial sequence
  specific aptamers
gguagguaugguaugugguauuu

SEQ ID NO: 1628 - RNA, 22 nt, Artificial sequence
  specific aptamers
gguagguaugguaugugguauu

SEQ ID NO: 1629 - RNA, 23 nt, Artificial sequence
  specific aptamers
gguagguuuggaaugugguaaau

SEQ ID NO: 1630 - RNA, 23 nt, Artificial sequence
  specific aptamers
gguagguuuggaaugugguaacu

SEQ ID NO: 1631 - RNA, 23 nt, Artificial sequence
  specific aptamers
gguagguuuggaaugugguaagu

SEQ ID NO: 1632 - RNA, 23 nt, Artificial sequence
  specific aptamers
gguagguuuggaaugugguaauu

SEQ ID NO: 1633 - RNA, 22 nt, Artificial sequence
  specific aptamers
gguagguuuggaaugugguaau

SEQ ID NO: 1634 - RNA, 23 nt, Artificial sequence
  specific aptamers
gguagguuuggaaugugguacau

SEQ ID NO: 1635 - RNA, 23 nt, Artificial sequence
  specific aptamers
gguagguuuggaaugugguaccu

SEQ ID NO: 1636 - RNA, 23 nt, Artificial sequence
  specific aptamers
gguagguuuggaaugugguacgu

SEQ ID NO: 1637 - RNA, 23 nt, Artificial sequence
  specific aptamers
gguagguuuggaaugugguacuu

SEQ ID NO: 1638 - RNA, 22 nt, Artificial sequence
  specific aptamers
gguagguuuggaaugugguacu

SEQ ID NO: 1639 - RNA, 23 nt, Artificial sequence
  specific aptamers
gguagguuuggaaugugguagau

SEQ ID NO: 1640 - RNA, 23 nt, Artificial sequence
  specific aptamers
gguagguuuggaaugugguagcu

SEQ ID NO: 1641 - RNA, 23 nt, Artificial sequence
  specific aptamers
gguagguuuggaaugugguaggu

SEQ ID NO: 1642 - RNA, 23 nt, Artificial sequence
  specific aptamers
gguagguuuggaaugugguaguu

SEQ ID NO: 1643 - RNA, 22 nt, Artificial sequence
  specific aptamers
gguagguuuggaaugugguagu

SEQ ID NO: 1644 - RNA, 23 nt, Artificial sequence
  specific aptamers
gguagguuuggaaugugguauau

SEQ ID NO: 1645 - RNA, 23 nt, Artificial sequence
  specific aptamers
gguagguuuggaaugugguaucu

SEQ ID NO: 1646 - RNA, 23 nt, Artificial sequence
  specific aptamers
gguagguuuggaaugugguaugu

SEQ ID NO: 1647 - RNA, 23 nt, Artificial sequence
  specific aptamers
gguagguuuggaaugugguauuu

SEQ ID NO: 1648 - RNA, 22 nt, Artificial sequence
  specific aptamers
gguagguuuggaaugugguauu

SEQ ID NO: 1649 - RNA, 23 nt, Artificial sequence
  specific aptamers
gguagguuuggcaugugguaaau

SEQ ID NO: 1650 - RNA, 23 nt, Artificial sequence
  specific aptamers
gguagguuuggcaugugguaacu

SEQ ID NO: 1651 - RNA, 23 nt, Artificial sequence
  specific aptamers
gguagguuuggcaugugguaagu

SEQ ID NO: 1652 - RNA, 23 nt, Artificial sequence
  specific aptamers
gguagguuuggcaugugguaauu

SEQ ID NO: 1653 - RNA, 22 nt, Artificial sequence
  specific aptamers
gguagguuuggcaugugguaau

SEQ ID NO: 1654 - RNA, 23 nt, Artificial sequence
  specific aptamers
gguagguuuggcaugugguacau

SEQ ID NO: 1655 - RNA, 23 nt, Artificial sequence
  specific aptamers
gguagguuuggcaugugguaccu

SEQ ID NO: 1656 - RNA, 23 nt, Artificial sequence
  specific aptamers
gguagguuuggcaugugguacgu

SEQ ID NO: 1657 - RNA, 23 nt, Artificial sequence
  specific aptamers
gguagguuuggcaugugguacuu

SEQ ID NO: 1658 - RNA, 22 nt, Artificial sequence
  specific aptamers
gguagguuuggcaugugguacu

SEQ ID NO: 1659 - RNA, 23 nt, Artificial sequence
  specific aptamers
gguagguuuggcaugugguagau

SEQ ID NO: 1660 - RNA, 23 nt, Artificial sequence
  specific aptamers
gguagguuuggcaugugguagcu

SEQ ID NO: 1661 - RNA, 23 nt, Artificial sequence
  specific aptamers
gguagguuuggcaugugguaggu

SEQ ID NO: 1662 - RNA, 23 nt, Artificial sequence
  specific aptamers
gguagguuuggcaugugguaguu

SEQ ID NO: 1663 - RNA, 22 nt, Artificial sequence
  specific aptamers
gguagguuuggcaugugguagu

SEQ ID NO: 1664 - RNA, 23 nt, Artificial sequence
  specific aptamers
gguagguuuggcaugugguauau

SEQ ID NO: 1665 - RNA, 23 nt, Artificial sequence
  specific aptamers
gguagguuuggcaugugguaucu

SEQ ID NO: 1666 - RNA, 23 nt, Artificial sequence
  specific aptamers
gguagguuuggcaugugguaugu

SEQ ID NO: 1667 - RNA, 23 nt, Artificial sequence
  specific aptamers
gguagguuuggcaugugguauuu

SEQ ID NO: 1668 - RNA, 22 nt, Artificial sequence
  specific aptamers
gguagguuuggcaugugguauu

SEQ ID NO: 1669 - RNA, 23 nt, Artificial sequence
  specific aptamers
gguagguuugguaugugguaaau

SEQ ID NO: 1670 - RNA, 23 nt, Artificial sequence
  specific aptamers
gguagguuugguaugugguaacu

SEQ ID NO: 1671 - RNA, 23 nt, Artificial sequence
  specific aptamers
gguagguuugguaugugguaagu

SEQ ID NO: 1672 - RNA, 23 nt, Artificial sequence
  specific aptamers
gguagguuugguaugugguaauu

SEQ ID NO: 1673 - RNA, 22 nt, Artificial sequence
  specific aptamers
gguagguuugguaugugguaau

SEQ ID NO: 1674 - RNA, 23 nt, Artificial sequence
  specific aptamers
gguagguuugguaugugguacau

SEQ ID NO: 1675 - RNA, 23 nt, Artificial sequence
  specific aptamers
gguagguuugguaugugguaccu

SEQ ID NO: 1676 - RNA, 23 nt, Artificial sequence
  specific aptamers
gguagguuugguaugugguacgu

SEQ ID NO: 1677 - RNA, 23 nt, Artificial sequence
  specific aptamers
gguagguuugguaugugguacuu

SEQ ID NO: 1678 - RNA, 22 nt, Artificial sequence
  specific aptamers
gguagguuugguaugugguacu

SEQ ID NO: 1679 - RNA, 23 nt, Artificial sequence
  specific aptamers
gguagguuugguaugugguagau

SEQ ID NO: 1680 - RNA, 23 nt, Artificial sequence
  specific aptamers
gguagguuugguaugugguagcu

SEQ ID NO: 1681 - RNA, 23 nt, Artificial sequence
  specific aptamers
gguagguuugguaugugguaggu

SEQ ID NO: 1682 - RNA, 23 nt, Artificial sequence
  specific aptamers
gguagguuugguaugugguaguu

SEQ ID NO: 1683 - RNA, 22 nt, Artificial sequence
  specific aptamers
gguagguuugguaugugguagu

SEQ ID NO: 1684 - RNA, 23 nt, Artificial sequence
  specific aptamers
gguagguuugguaugugguauau

SEQ ID NO: 1685 - RNA, 23 nt, Artificial sequence
  specific aptamers
gguagguuugguaugugguaucu

SEQ ID NO: 1686 - RNA, 23 nt, Artificial sequence
  specific aptamers
gguagguuugguaugugguaugu

SEQ ID NO: 1687 - RNA, 23 nt, Artificial sequence
  specific aptamers
gguagguuugguaugugguauuu

SEQ ID NO: 1688 - RNA, 22 nt, Artificial sequence
  specific aptamers
gguagguuugguaugugguauu

SEQ ID NO: 1689 - RNA, 23 nt, Artificial sequence
  specific aptamers
ggaagguauggaaugggguaaau

SEQ ID NO: 1690 - RNA, 23 nt, Artificial sequence
  specific aptamers
ggaagguauggaaugggguaacu

SEQ ID NO: 1691 - RNA, 23 nt, Artificial sequence
  specific aptamers
ggaagguauggaaugggguaagu

SEQ ID NO: 1692 - RNA, 23 nt, Artificial sequence
  specific aptamers
ggaagguauggaaugggguaauu

SEQ ID NO: 1693 - RNA, 22 nt, Artificial sequence
  specific aptamers
ggaagguauggaaugggguaau

SEQ ID NO: 1694 - RNA, 23 nt, Artificial sequence
  specific aptamers
ggaagguauggaaugggguacau

SEQ ID NO: 1695 - RNA, 23 nt, Artificial sequence
  specific aptamers
ggaagguauggaaugggguaccu

SEQ ID NO: 1696 - RNA, 23 nt, Artificial sequence
  specific aptamers
ggaagguauggaaugggguacgu

SEQ ID NO: 1697 - RNA, 23 nt, Artificial sequence
  specific aptamers
ggaagguauggaaugggguacuu

SEQ ID NO: 1698 - RNA, 22 nt, Artificial sequence
  specific aptamers
ggaagguauggaaugggguacu

SEQ ID NO: 1699 - RNA, 23 nt, Artificial sequence
  specific aptamers
ggaagguauggaaugggguagau

SEQ ID NO: 1700 - RNA, 23 nt, Artificial sequence
  specific aptamers
ggaagguauggaaugggguagcu

SEQ ID NO: 1701 - RNA, 23 nt, Artificial sequence
  specific aptamers
ggaagguauggaaugggguaggu

SEQ ID NO: 1702 - RNA, 23 nt, Artificial sequence
  specific aptamers
ggaagguauggaaugggguaguu

SEQ ID NO: 1703 - RNA, 22 nt, Artificial sequence
  specific aptamers
ggaagguauggaaugggguagu

SEQ ID NO: 1704 - RNA, 23 nt, Artificial sequence
  specific aptamers
ggaagguauggaaugggguauau

SEQ ID NO: 1705 - RNA, 23 nt, Artificial sequence
  specific aptamers
ggaagguauggaaugggguaucu

SEQ ID NO: 1706 - RNA, 23 nt, Artificial sequence
  specific aptamers
ggaagguauggaaugggguaugu

SEQ ID NO: 1707 - RNA, 23 nt, Artificial sequence
  specific aptamers
ggaagguauggaaugggguauuu

SEQ ID NO: 1708 - RNA, 22 nt, Artificial sequence
  specific aptamers
ggaagguauggaaugggguauu

SEQ ID NO: 1709 - RNA, 23 nt, Artificial sequence
  specific aptamers
ggaagguauggcaugggguaaau

SEQ ID NO: 1710 - RNA, 23 nt, Artificial sequence
  specific aptamers
ggaagguauggcaugggguaacu

SEQ ID NO: 1711 - RNA, 23 nt, Artificial sequence
  specific aptamers
ggaagguauggcaugggguaagu

SEQ ID NO: 1712 - RNA, 23 nt, Artificial sequence
  specific aptamers
ggaagguauggcaugggguaauu

SEQ ID NO: 1713 - RNA, 22 nt, Artificial sequence
  specific aptamers
ggaagguauggcaugggguaau

SEQ ID NO: 1714 - RNA, 23 nt, Artificial sequence
  specific aptamers
ggaagguauggcaugggguacau

SEQ ID NO: 1715 - RNA, 23 nt, Artificial sequence
  specific aptamers
ggaagguauggcaugggguaccu

SEQ ID NO: 1716 - RNA, 23 nt, Artificial sequence
  specific aptamers
ggaagguauggcaugggguacgu

SEQ ID NO: 1717 - RNA, 23 nt, Artificial sequence
  specific aptamers
ggaagguauggcaugggguacuu

SEQ ID NO: 1718 - RNA, 22 nt, Artificial sequence
  specific aptamers
ggaagguauggcaugggguacu

SEQ ID NO: 1719 - RNA, 23 nt, Artificial sequence
  specific aptamers
ggaagguauggcaugggguagau

SEQ ID NO: 1720 - RNA, 23 nt, Artificial sequence
  specific aptamers
ggaagguauggcaugggguagcu

SEQ ID NO: 1721 - RNA, 23 nt, Artificial sequence
  specific aptamers
ggaagguauggcaugggguaggu

SEQ ID NO: 1722 - RNA, 23 nt, Artificial sequence
  specific aptamers
ggaagguauggcaugggguaguu

SEQ ID NO: 1723 - RNA, 22 nt, Artificial sequence
  specific aptamers
ggaagguauggcaugggguagu

SEQ ID NO: 1724 - RNA, 23 nt, Artificial sequence
  specific aptamers
ggaagguauggcaugggguauau

SEQ ID NO: 1725 - RNA, 23 nt, Artificial sequence
  specific aptamers
ggaagguauggcaugggguaucu

SEQ ID NO: 1726 - RNA, 23 nt, Artificial sequence
  specific aptamers
ggaagguauggcaugggguaugu

SEQ ID NO: 1727 - RNA, 23 nt, Artificial sequence
  specific aptamers
ggaagguauggcaugggguauuu

SEQ ID NO: 1728 - RNA, 22 nt, Artificial sequence
  specific aptamers
ggaagguauggcaugggguauu

SEQ ID NO: 1729 - RNA, 23 nt, Artificial sequence
  specific aptamers
ggaagguaugguaugggguaaau

SEQ ID NO: 1730 - RNA, 23 nt, Artificial sequence
  specific aptamers
ggaagguaugguaugggguaacu

SEQ ID NO: 1731 - RNA, 23 nt, Artificial sequence
  specific aptamers
ggaagguaugguaugggguaagu

SEQ ID NO: 1732 - RNA, 23 nt, Artificial sequence
  specific aptamers
ggaagguaugguaugggguaauu

SEQ ID NO: 1733 - RNA, 22 nt, Artificial sequence
  specific aptamers
ggaagguaugguaugggguaau

SEQ ID NO: 1734 - RNA, 23 nt, Artificial sequence
  specific aptamers
ggaagguaugguaugggguacau

SEQ ID NO: 1735 - RNA, 23 nt, Artificial sequence
  specific aptamers
ggaagguaugguaugggguaccu

SEQ ID NO: 1736 - RNA, 23 nt, Artificial sequence
  specific aptamers
ggaagguaugguaugggguacgu

SEQ ID NO: 1737 - RNA, 23 nt, Artificial sequence
  specific aptamers
ggaagguaugguaugggguacuu

SEQ ID NO: 1738 - RNA, 22 nt, Artificial sequence
  specific aptamers
ggaagguaugguaugggguacu

SEQ ID NO: 1739 - RNA, 23 nt, Artificial sequence
  specific aptamers
ggaagguaugguaugggguagau

SEQ ID NO: 1740 - RNA, 23 nt, Artificial sequence
  specific aptamers
ggaagguaugguaugggguagcu

SEQ ID NO: 1741 - RNA, 23 nt, Artificial sequence
  specific aptamers
ggaagguaugguaugggguaggu

SEQ ID NO: 1742 - RNA, 23 nt, Artificial sequence
  specific aptamers
ggaagguaugguaugggguaguu

SEQ ID NO: 1743 - RNA, 22 nt, Artificial sequence
  specific aptamers
ggaagguaugguaugggguagu

SEQ ID NO: 1744 - RNA, 23 nt, Artificial sequence
  specific aptamers
ggaagguaugguaugggguauau

SEQ ID NO: 1745 - RNA, 23 nt, Artificial sequence
  specific aptamers
ggaagguaugguaugggguaucu

SEQ ID NO: 1746 - RNA, 23 nt, Artificial sequence
  specific aptamers
ggaagguaugguaugggguaugu

SEQ ID NO: 1747 - RNA, 23 nt, Artificial sequence
  specific aptamers
ggaagguaugguaugggguauuu

SEQ ID NO: 1748 - RNA, 22 nt, Artificial sequence
  specific aptamers
ggaagguaugguaugggguauu

SEQ ID NO: 1749 - RNA, 23 nt, Artificial sequence
  specific aptamers
ggaagguuuggaaugggguaaau

SEQ ID NO: 1750 - RNA, 23 nt, Artificial sequence
  specific aptamers
ggaagguuuggaaugggguaacu

SEQ ID NO: 1751 - RNA, 23 nt, Artificial sequence
  specific aptamers
ggaagguuuggaaugggguaagu

SEQ ID NO: 1752 - RNA, 23 nt, Artificial sequence
  specific aptamers
ggaagguuuggaaugggguaauu

SEQ ID NO: 1753 - RNA, 22 nt, Artificial sequence
  specific aptamers
ggaagguuuggaaugggguaau

SEQ ID NO: 1754 - RNA, 23 nt, Artificial sequence
  specific aptamers
ggaagguuuggaaugggguacau

SEQ ID NO: 1755 - RNA, 23 nt, Artificial sequence
  specific aptamers
ggaagguuuggaaugggguaccu

SEQ ID NO: 1756 - RNA, 23 nt, Artificial sequence
  specific aptamers
ggaagguuuggaaugggguacgu

SEQ ID NO: 1757 - RNA, 23 nt, Artificial sequence
  specific aptamers
ggaagguuuggaaugggguacuu

SEQ ID NO: 1758 - RNA, 22 nt, Artificial sequence
  specific aptamers
ggaagguuuggaaugggguacu

SEQ ID NO: 1759 - RNA, 23 nt, Artificial sequence
  specific aptamers
ggaagguuuggaaugggguagau

SEQ ID NO: 1760 - RNA, 23 nt, Artificial sequence
  specific aptamers
ggaagguuuggaaugggguagcu

SEQ ID NO: 1761 - RNA, 23 nt, Artificial sequence
  specific aptamers
ggaagguuuggaaugggguaggu

SEQ ID NO: 1762 - RNA, 23 nt, Artificial sequence
  specific aptamers
ggaagguuuggaaugggguaguu

SEQ ID NO: 1763 - RNA, 22 nt, Artificial sequence
  specific aptamers
ggaagguuuggaaugggguagu

SEQ ID NO: 1764 - RNA, 23 nt, Artificial sequence
  specific aptamers
ggaagguuuggaaugggguauau

SEQ ID NO: 1765 - RNA, 23 nt, Artificial sequence
  specific aptamers
ggaagguuuggaaugggguaucu

SEQ ID NO: 1766 - RNA, 23 nt, Artificial sequence
  specific aptamers
ggaagguuuggaaugggguaugu

SEQ ID NO: 1767 - RNA, 23 nt, Artificial sequence
  specific aptamers
ggaagguuuggaaugggguauuu

SEQ ID NO: 1768 - RNA, 22 nt, Artificial sequence
  specific aptamers
ggaagguuuggaaugggguauu

SEQ ID NO: 1769 - RNA, 23 nt, Artificial sequence
  specific aptamers
ggaagguuuggcaugggguaaau

SEQ ID NO: 1770 - RNA, 23 nt, Artificial sequence
  specific aptamers
ggaagguuuggcaugggguaacu

SEQ ID NO: 1771 - RNA, 23 nt, Artificial sequence
  specific aptamers
ggaagguuuggcaugggguaagu

SEQ ID NO: 1772 - RNA, 23 nt, Artificial sequence
  specific aptamers
ggaagguuuggcaugggguaauu

SEQ ID NO: 1773 - RNA, 22 nt, Artificial sequence
  specific aptamers
ggaagguuuggcaugggguaau

SEQ ID NO: 1774 - RNA, 23 nt, Artificial sequence
  specific aptamers
ggaagguuuggcaugggguacau

SEQ ID NO: 1775 - RNA, 23 nt, Artificial sequence
  specific aptamers
ggaagguuuggcaugggguaccu

SEQ ID NO: 1776 - RNA, 23 nt, Artificial sequence
  specific aptamers
ggaagguuuggcaugggguacgu

SEQ ID NO: 1777 - RNA, 23 nt, Artificial sequence
  specific aptamers
ggaagguuuggcaugggguacuu

SEQ ID NO: 1778 - RNA, 22 nt, Artificial sequence
  specific aptamers
ggaagguuuggcaugggguacu

SEQ ID NO: 1779 - RNA, 23 nt, Artificial sequence
  specific aptamers
ggaagguuuggcaugggguagau

SEQ ID NO: 1780 - RNA, 23 nt, Artificial sequence
  specific aptamers
ggaagguuuggcaugggguagcu

SEQ ID NO: 1781 - RNA, 23 nt, Artificial sequence
  specific aptamers
ggaagguuuggcaugggguaggu

SEQ ID NO: 1782 - RNA, 23 nt, Artificial sequence
  specific aptamers
ggaagguuuggcaugggguaguu

SEQ ID NO: 1783 - RNA, 22 nt, Artificial sequence
  specific aptamers
ggaagguuuggcaugggguagu

SEQ ID NO: 1784 - RNA, 23 nt, Artificial sequence
  specific aptamers
ggaagguuuggcaugggguauau

SEQ ID NO: 1785 - RNA, 23 nt, Artificial sequence
  specific aptamers
ggaagguuuggcaugggguaucu

SEQ ID NO: 1786 - RNA, 23 nt, Artificial sequence
  specific aptamers
ggaagguuuggcaugggguaugu

SEQ ID NO: 1787 - RNA, 23 nt, Artificial sequence
  specific aptamers
ggaagguuuggcaugggguauuu

SEQ ID NO: 1788 - RNA, 22 nt, Artificial sequence
  specific aptamers
ggaagguuuggcaugggguauu

SEQ ID NO: 1789 - RNA, 23 nt, Artificial sequence
  specific aptamers
ggaagguuugguaugggguaaau

SEQ ID NO: 1790 - RNA, 23 nt, Artificial sequence
  specific aptamers
ggaagguuugguaugggguaacu

SEQ ID NO: 1791 - RNA, 23 nt, Artificial sequence
  specific aptamers
ggaagguuugguaugggguaagu

SEQ ID NO: 1792 - RNA, 23 nt, Artificial sequence
  specific aptamers
ggaagguuugguaugggguaauu

SEQ ID NO: 1793 - RNA, 22 nt, Artificial sequence
  specific aptamers
ggaagguuugguaugggguaau

SEQ ID NO: 1794 - RNA, 23 nt, Artificial sequence
  specific aptamers
ggaagguuugguaugggguacau

SEQ ID NO: 1795 - RNA, 23 nt, Artificial sequence
  specific aptamers
ggaagguuugguaugggguaccu

SEQ ID NO: 1796 - RNA, 23 nt, Artificial sequence
  specific aptamers
ggaagguuugguaugggguacgu

SEQ ID NO: 1797 - RNA, 23 nt, Artificial sequence
  specific aptamers
ggaagguuugguaugggguacuu

SEQ ID NO: 1798 - RNA, 22 nt, Artificial sequence
  specific aptamers
ggaagguuugguaugggguacu

SEQ ID NO: 1799 - RNA, 23 nt, Artificial sequence
  specific aptamers
ggaagguuugguaugggguagau

SEQ ID NO: 1800 - RNA, 23 nt, Artificial sequence
  specific aptamers
ggaagguuugguaugggguagcu

SEQ ID NO: 1801 - RNA, 23 nt, Artificial sequence
  specific aptamers
ggaagguuugguaugggguaggu

SEQ ID NO: 1802 - RNA, 23 nt, Artificial sequence
  specific aptamers
ggaagguuugguaugggguaguu

SEQ ID NO: 1803 - RNA, 22 nt, Artificial sequence
  specific aptamers
ggaagguuugguaugggguagu

SEQ ID NO: 1804 - RNA, 23 nt, Artificial sequence
  specific aptamers
ggaagguuugguaugggguauau

SEQ ID NO: 1805 - RNA, 23 nt, Artificial sequence
  specific aptamers
ggaagguuugguaugggguaucu

SEQ ID NO: 1806 - RNA, 23 nt, Artificial sequence
  specific aptamers
ggaagguuugguaugggguaugu

SEQ ID NO: 1807 - RNA, 23 nt, Artificial sequence
  specific aptamers
ggaagguuugguaugggguauuu

SEQ ID NO: 1808 - RNA, 22 nt, Artificial sequence
  specific aptamers
ggaagguuugguaugggguauu

SEQ ID NO: 1809 - RNA, 23 nt, Artificial sequence
  specific aptamers
gguagguauggaaugggguaaau

SEQ ID NO: 1810 - RNA, 23 nt, Artificial sequence
  specific aptamers
gguagguauggaaugggguaacu

SEQ ID NO: 1811 - RNA, 23 nt, Artificial sequence
  specific aptamers
gguagguauggaaugggguaagu

SEQ ID NO: 1812 - RNA, 23 nt, Artificial sequence
  specific aptamers
gguagguauggaaugggguaauu

SEQ ID NO: 1813 - RNA, 22 nt, Artificial sequence
  specific aptamers
gguagguauggaaugggguaau

SEQ ID NO: 1814 - RNA, 23 nt, Artificial sequence
  specific aptamers
gguagguauggaaugggguacau

SEQ ID NO: 1815 - RNA, 23 nt, Artificial sequence
  specific aptamers
gguagguauggaaugggguaccu

SEQ ID NO: 1816 - RNA, 23 nt, Artificial sequence
  specific aptamers
gguagguauggaaugggguacgu

SEQ ID NO: 1817 - RNA, 23 nt, Artificial sequence
  specific aptamers
gguagguauggaaugggguacuu

SEQ ID NO: 1818 - RNA, 22 nt, Artificial sequence
  specific aptamers
gguagguauggaaugggguacu

SEQ ID NO: 1819 - RNA, 23 nt, Artificial sequence
  specific aptamers
gguagguauggaaugggguagau

SEQ ID NO: 1820 - RNA, 23 nt, Artificial sequence
  specific aptamers
gguagguauggaaugggguagcu

SEQ ID NO: 1821 - RNA, 23 nt, Artificial sequence
  specific aptamers
gguagguauggaaugggguaggu

SEQ ID NO: 1822 - RNA, 23 nt, Artificial sequence
  specific aptamers
gguagguauggaaugggguaguu

SEQ ID NO: 1823 - RNA, 22 nt, Artificial sequence
  specific aptamers
gguagguauggaaugggguagu

SEQ ID NO: 1824 - RNA, 23 nt, Artificial sequence
  specific aptamers
gguagguauggaaugggguauau

SEQ ID NO: 1825 - RNA, 23 nt, Artificial sequence
  specific aptamers
gguagguauggaaugggguaucu

SEQ ID NO: 1826 - RNA, 23 nt, Artificial sequence
  specific aptamers
gguagguauggaaugggguaugu

SEQ ID NO: 1827 - RNA, 23 nt, Artificial sequence
  specific aptamers
gguagguauggaaugggguauuu

SEQ ID NO: 1828 - RNA, 22 nt, Artificial sequence
  specific aptamers
gguagguauggaaugggguauu

SEQ ID NO: 1829 - RNA, 23 nt, Artificial sequence
  specific aptamers
gguagguauggcaugggguaaau

SEQ ID NO: 1830 - RNA, 23 nt, Artificial sequence
  specific aptamers
gguagguauggcaugggguaacu

SEQ ID NO: 1831 - RNA, 23 nt, Artificial sequence
  specific aptamers
gguagguauggcaugggguaagu

SEQ ID NO: 1832 - RNA, 23 nt, Artificial sequence
  specific aptamers
gguagguauggcaugggguaauu

SEQ ID NO: 1833 - RNA, 22 nt, Artificial sequence
  specific aptamers
gguagguauggcaugggguaau

SEQ ID NO: 1834 - RNA, 23 nt, Artificial sequence
  specific aptamers
gguagguauggcaugggguacau

SEQ ID NO: 1835 - RNA, 23 nt, Artificial sequence
  specific aptamers
gguagguauggcaugggguaccu

SEQ ID NO: 1836 - RNA, 23 nt, Artificial sequence
  specific aptamers
gguagguauggcaugggguacgu

SEQ ID NO: 1837 - RNA, 23 nt, Artificial sequence
  specific aptamers
gguagguauggcaugggguacuu

SEQ ID NO: 1838 - RNA, 22 nt, Artificial sequence
  specific aptamers
gguagguauggcaugggguacu

SEQ ID NO: 1839 - RNA, 23 nt, Artificial sequence
  specific aptamers
gguagguauggcaugggguagau

SEQ ID NO: 1840 - RNA, 23 nt, Artificial sequence
  specific aptamers
gguagguauggcaugggguagcu

SEQ ID NO: 1841 - RNA, 23 nt, Artificial sequence
  specific aptamers
gguagguauggcaugggguaggu

SEQ ID NO: 1842 - RNA, 23 nt, Artificial sequence
  specific aptamers
gguagguauggcaugggguaguu

SEQ ID NO: 1843 - RNA, 22 nt, Artificial sequence
  specific aptamers
gguagguauggcaugggguagu

SEQ ID NO: 1844 - RNA, 23 nt, Artificial sequence
  specific aptamers
gguagguauggcaugggguauau

SEQ ID NO: 1845 - RNA, 23 nt, Artificial sequence
  specific aptamers
gguagguauggcaugggguaucu

SEQ ID NO: 1846 - RNA, 23 nt, Artificial sequence
  specific aptamers
gguagguauggcaugggguaugu

SEQ ID NO: 1847 - RNA, 23 nt, Artificial sequence
  specific aptamers
gguagguauggcaugggguauuu

SEQ ID NO: 1848 - RNA, 22 nt, Artificial sequence
  specific aptamers
gguagguauggcaugggguauu

SEQ ID NO: 1849 - RNA, 23 nt, Artificial sequence
  specific aptamers
gguagguaugguaugggguaaau

SEQ ID NO: 1850 - RNA, 23 nt, Artificial sequence
  specific aptamers
gguagguaugguaugggguaacu

SEQ ID NO: 1851 - RNA, 23 nt, Artificial sequence
  specific aptamers
gguagguaugguaugggguaagu

SEQ ID NO: 1852 - RNA, 23 nt, Artificial sequence
  specific aptamers
gguagguaugguaugggguaauu

SEQ ID NO: 1853 - RNA, 22 nt, Artificial sequence
  specific aptamers
gguagguaugguaugggguaau

SEQ ID NO: 1854 - RNA, 23 nt, Artificial sequence
  specific aptamers
gguagguaugguaugggguacau

SEQ ID NO: 1855 - RNA, 23 nt, Artificial sequence
  specific aptamers
gguagguaugguaugggguaccu

SEQ ID NO: 1856 - RNA, 23 nt, Artificial sequence
  specific aptamers
gguagguaugguaugggguacgu

SEQ ID NO: 1857 - RNA, 23 nt, Artificial sequence
  specific aptamers
gguagguaugguaugggguacuu

SEQ ID NO: 1858 - RNA, 22 nt, Artificial sequence
  specific aptamers
gguagguaugguaugggguacu

SEQ ID NO: 1859 - RNA, 23 nt, Artificial sequence
  specific aptamers
gguagguaugguaugggguagau

SEQ ID NO: 1860 - RNA, 23 nt, Artificial sequence
  specific aptamers
gguagguaugguaugggguagcu

SEQ ID NO: 1861 - RNA, 23 nt, Artificial sequence
  specific aptamers
gguagguaugguaugggguaggu

SEQ ID NO: 1862 - RNA, 23 nt, Artificial sequence
  specific aptamers
gguagguaugguaugggguaguu

SEQ ID NO: 1863 - RNA, 22 nt, Artificial sequence
  specific aptamers
gguagguaugguaugggguagu

SEQ ID NO: 1864 - RNA, 23 nt, Artificial sequence
  specific aptamers
gguagguaugguaugggguauau

SEQ ID NO: 1865 - RNA, 23 nt, Artificial sequence
  specific aptamers
gguagguaugguaugggguaucu

SEQ ID NO: 1866 - RNA, 23 nt, Artificial sequence
  specific aptamers
gguagguaugguaugggguaugu

SEQ ID NO: 1867 - RNA, 23 nt, Artificial sequence
  specific aptamers
gguagguaugguaugggguauuu

SEQ ID NO: 1868 - RNA, 22 nt, Artificial sequence
  specific aptamers
gguagguaugguaugggguauu

SEQ ID NO: 1869 - RNA, 23 nt, Artificial sequence
  specific aptamers
gguagguuuggaaugggguaaau

SEQ ID NO: 1870 - RNA, 23 nt, Artificial sequence
  specific aptamers
gguagguuuggaaugggguaacu

SEQ ID NO: 1871 - RNA, 23 nt, Artificial sequence
  specific aptamers
gguagguuuggaaugggguaagu

SEQ ID NO: 1872 - RNA, 23 nt, Artificial sequence
  specific aptamers
gguagguuuggaaugggguaauu

SEQ ID NO: 1873 - RNA, 22 nt, Artificial sequence
  specific aptamers
gguagguuuggaaugggguaau

SEQ ID NO: 1874 - RNA, 23 nt, Artificial sequence
  specific aptamers
gguagguuuggaaugggguacau

SEQ ID NO: 1875 - RNA, 23 nt, Artificial sequence
  specific aptamers
gguagguuuggaaugggguaccu

SEQ ID NO: 1876 - RNA, 23 nt, Artificial sequence
  specific aptamers
gguagguuuggaaugggguacgu

SEQ ID NO: 1877 - RNA, 23 nt, Artificial sequence
  specific aptamers
gguagguuuggaaugggguacuu

SEQ ID NO: 1878 - RNA, 22 nt, Artificial sequence
  specific aptamers
gguagguuuggaaugggguacu

SEQ ID NO: 1879 - RNA, 23 nt, Artificial sequence
  specific aptamers
gguagguuuggaaugggguagau

SEQ ID NO: 1880 - RNA, 23 nt, Artificial sequence
  specific aptamers
gguagguuuggaaugggguagcu

SEQ ID NO: 1881 - RNA, 23 nt, Artificial sequence
  specific aptamers
gguagguuuggaaugggguaggu

SEQ ID NO: 1882 - RNA, 23 nt, Artificial sequence
  specific aptamers
gguagguuuggaaugggguaguu

SEQ ID NO: 1883 - RNA, 22 nt, Artificial sequence
  specific aptamers
gguagguuuggaaugggguagu

SEQ ID NO: 1884 - RNA, 23 nt, Artificial sequence
  specific aptamers
gguagguuuggaaugggguauau

SEQ ID NO: 1885 - RNA, 23 nt, Artificial sequence
  specific aptamers
gguagguuuggaaugggguaucu

SEQ ID NO: 1886 - RNA, 23 nt, Artificial sequence
  specific aptamers
gguagguuuggaaugggguaugu

SEQ ID NO: 1887 - RNA, 23 nt, Artificial sequence
  specific aptamers
gguagguuuggaaugggguauuu

SEQ ID NO: 1888 - RNA, 22 nt, Artificial sequence
  specific aptamers
gguagguuuggaaugggguauu

SEQ ID NO: 1889 - RNA, 23 nt, Artificial sequence
  specific aptamers
gguagguuuggcaugggguaaau

SEQ ID NO: 1890 - RNA, 23 nt, Artificial sequence
  specific aptamers
gguagguuuggcaugggguaacu

SEQ ID NO: 1891 - RNA, 23 nt, Artificial sequence
  specific aptamers
gguagguuuggcaugggguaagu

SEQ ID NO: 1892 - RNA, 23 nt, Artificial sequence
  specific aptamers
gguagguuuggcaugggguaauu

SEQ ID NO: 1893 - RNA, 22 nt, Artificial sequence
  specific aptamers
gguagguuuggcaugggguaau

SEQ ID NO: 1894 - RNA, 23 nt, Artificial sequence
  specific aptamers
gguagguuuggcaugggguacau

SEQ ID NO: 1895 - RNA, 23 nt, Artificial sequence
  specific aptamers
gguagguuuggcaugggguaccu

SEQ ID NO: 1896 - RNA, 23 nt, Artificial sequence
  specific aptamers
gguagguuuggcaugggguacgu

SEQ ID NO: 1897 - RNA, 23 nt, Artificial sequence
  specific aptamers
gguagguuuggcaugggguacuu

SEQ ID NO: 1898 - RNA, 22 nt, Artificial sequence
  specific aptamers
gguagguuuggcaugggguacu

SEQ ID NO: 1899 - RNA, 23 nt, Artificial sequence
  specific aptamers
gguagguuuggcaugggguagau

SEQ ID NO: 1900 - RNA, 23 nt, Artificial sequence
  specific aptamers
gguagguuuggcaugggguagcu

SEQ ID NO: 1901 - RNA, 23 nt, Artificial sequence
  specific aptamers
gguagguuuggcaugggguaggu

SEQ ID NO: 1902 - RNA, 23 nt, Artificial sequence
  specific aptamers
gguagguuuggcaugggguaguu

SEQ ID NO: 1903 - RNA, 22 nt, Artificial sequence
  specific aptamers
gguagguuuggcaugggguagu

SEQ ID NO: 1904 - RNA, 23 nt, Artificial sequence
  specific aptamers
gguagguuuggcaugggguauau

SEQ ID NO: 1905 - RNA, 23 nt, Artificial sequence
  specific aptamers
gguagguuuggcaugggguaucu

SEQ ID NO: 1906 - RNA, 23 nt, Artificial sequence
  specific aptamers
gguagguuuggcaugggguaugu

SEQ ID NO: 1907 - RNA, 23 nt, Artificial sequence
  specific aptamers
gguagguuuggcaugggguauuu

SEQ ID NO: 1908 - RNA, 22 nt, Artificial sequence
  specific aptamers
gguagguuuggcaugggguauu

SEQ ID NO: 1909 - RNA, 23 nt, Artificial sequence
  specific aptamers
gguagguuugguaugggguaaau

SEQ ID NO: 1910 - RNA, 23 nt, Artificial sequence
  specific aptamers
gguagguuugguaugggguaacu

SEQ ID NO: 1911 - RNA, 23 nt, Artificial sequence
  specific aptamers
gguagguuugguaugggguaagu

SEQ ID NO: 1912 - RNA, 23 nt, Artificial sequence
  specific aptamers
gguagguuugguaugggguaauu

SEQ ID NO: 1913 - RNA, 22 nt, Artificial sequence
  specific aptamers
gguagguuugguaugggguaau

SEQ ID NO: 1914 - RNA, 23 nt, Artificial sequence
  specific aptamers
gguagguuugguaugggguacau

SEQ ID NO: 1915 - RNA, 23 nt, Artificial sequence
  specific aptamers
gguagguuugguaugggguaccu

SEQ ID NO: 1916 - RNA, 23 nt, Artificial sequence
  specific aptamers
gguagguuugguaugggguacgu

SEQ ID NO: 1917 - RNA, 23 nt, Artificial sequence
  specific aptamers
gguagguuugguaugggguacuu

SEQ ID NO: 1918 - RNA, 22 nt, Artificial sequence
  specific aptamers
gguagguuugguaugggguacu

SEQ ID NO: 1919 - RNA, 23 nt, Artificial sequence
  specific aptamers
gguagguuugguaugggguagau

SEQ ID NO: 1920 - RNA, 23 nt, Artificial sequence
  specific aptamers
gguagguuugguaugggguagcu

SEQ ID NO: 1921 - RNA, 23 nt, Artificial sequence
  specific aptamers
gguagguuugguaugggguaggu

SEQ ID NO: 1922 - RNA, 23 nt, Artificial sequence
  specific aptamers
gguagguuugguaugggguaguu

SEQ ID NO: 1923 - RNA, 22 nt, Artificial sequence
  specific aptamers
gguagguuugguaugggguagu

SEQ ID NO: 1924 - RNA, 23 nt, Artificial sequence
  specific aptamers
gguagguuugguaugggguauau

SEQ ID NO: 1925 - RNA, 23 nt, Artificial sequence
  specific aptamers
gguagguuugguaugggguaucu

SEQ ID NO: 1926 - RNA, 23 nt, Artificial sequence
  specific aptamers
gguagguuugguaugggguaugu

SEQ ID NO: 1927 - RNA, 23 nt, Artificial sequence
  specific aptamers
gguagguuugguaugggguauuu

SEQ ID NO: 1928 - RNA, 22 nt, Artificial sequence
  specific aptamers
gguagguuugguaugggguauu

SEQ ID NO: 1929 - RNA, 23 nt, Artificial sequence
  specific aptamers
ggacgguauggaaugugguaaag

SEQ ID NO: 1930 - RNA, 23 nt, Artificial sequence
  specific aptamers
ggacgguauggaaugugguaacg

SEQ ID NO: 1931 - RNA, 23 nt, Artificial sequence
  specific aptamers
ggacgguauggaaugugguaagg

SEQ ID NO: 1932 - RNA, 23 nt, Artificial sequence
  specific aptamers
ggacgguauggaaugugguaaug

SEQ ID NO: 1933 - RNA, 22 nt, Artificial sequence
  specific aptamers
ggacgguauggaaugugguaag

SEQ ID NO: 1934 - RNA, 23 nt, Artificial sequence
  specific aptamers
ggacgguauggaaugugguacag

SEQ ID NO: 1935 - RNA, 23 nt, Artificial sequence
  specific aptamers
ggacgguauggaaugugguaccg

SEQ ID NO: 1936 - RNA, 23 nt, Artificial sequence
  specific aptamers
ggacgguauggaaugugguacgg

SEQ ID NO: 1937 - RNA, 23 nt, Artificial sequence
  specific aptamers
ggacgguauggaaugugguacug

SEQ ID NO: 1938 - RNA, 22 nt, Artificial sequence
  specific aptamers
ggacgguauggaaugugguacg

SEQ ID NO: 1939 - RNA, 23 nt, Artificial sequence
  specific aptamers
ggacgguauggaaugugguagag

SEQ ID NO: 1940 - RNA, 23 nt, Artificial sequence
  specific aptamers
ggacgguauggaaugugguagcg

SEQ ID NO: 1941 - RNA, 23 nt, Artificial sequence
  specific aptamers
ggacgguauggaaugugguaggg

SEQ ID NO: 1942 - RNA, 23 nt, Artificial sequence
  specific aptamers
ggacgguauggaaugugguagug

SEQ ID NO: 1943 - RNA, 22 nt, Artificial sequence
  specific aptamers
ggacgguauggaaugugguagg

SEQ ID NO: 1944 - RNA, 23 nt, Artificial sequence
  specific aptamers
ggacgguauggaaugugguauag

SEQ ID NO: 1945 - RNA, 23 nt, Artificial sequence
  specific aptamers
ggacgguauggaaugugguaucg

SEQ ID NO: 1946 - RNA, 23 nt, Artificial sequence
  specific aptamers
ggacgguauggaaugugguaugg

SEQ ID NO: 1947 - RNA, 23 nt, Artificial sequence
  specific aptamers
ggacgguauggaaugugguauug

SEQ ID NO: 1948 - RNA, 22 nt, Artificial sequence
  specific aptamers
ggacgguauggaaugugguaug

SEQ ID NO: 1949 - RNA, 23 nt, Artificial sequence
  specific aptamers
ggacgguauggcaugugguaaag

SEQ ID NO: 1950 - RNA, 23 nt, Artificial sequence
  specific aptamers
ggacgguauggcaugugguaacg

SEQ ID NO: 1951 - RNA, 23 nt, Artificial sequence
  specific aptamers
ggacgguauggcaugugguaagg

SEQ ID NO: 1952 - RNA, 23 nt, Artificial sequence
  specific aptamers
ggacgguauggcaugugguaaug

SEQ ID NO: 1953 - RNA, 22 nt, Artificial sequence
  specific aptamers
ggacgguauggcaugugguaag

SEQ ID NO: 1954 - RNA, 23 nt, Artificial sequence
  specific aptamers
ggacgguauggcaugugguacag

SEQ ID NO: 1955 - RNA, 23 nt, Artificial sequence
  specific aptamers
ggacgguauggcaugugguaccg

SEQ ID NO: 1956 - RNA, 23 nt, Artificial sequence
  specific aptamers
ggacgguauggcaugugguacgg

SEQ ID NO: 1957 - RNA, 23 nt, Artificial sequence
  specific aptamers
ggacgguauggcaugugguacug

SEQ ID NO: 1958 - RNA, 22 nt, Artificial sequence
  specific aptamers
ggacgguauggcaugugguacg

SEQ ID NO: 1959 - RNA, 23 nt, Artificial sequence
  specific aptamers
ggacgguauggcaugugguagag

SEQ ID NO: 1960 - RNA, 23 nt, Artificial sequence
  specific aptamers
ggacgguauggcaugugguagcg

SEQ ID NO: 1961 - RNA, 23 nt, Artificial sequence
  specific aptamers
ggacgguauggcaugugguaggg

SEQ ID NO: 1962 - RNA, 23 nt, Artificial sequence
  specific aptamers
ggacgguauggcaugugguagug

SEQ ID NO: 1963 - RNA, 22 nt, Artificial sequence
  specific aptamers
ggacgguauggcaugugguagg

SEQ ID NO: 1964 - RNA, 23 nt, Artificial sequence
  specific aptamers
ggacgguauggcaugugguauag

SEQ ID NO: 1965 - RNA, 23 nt, Artificial sequence
  specific aptamers
ggacgguauggcaugugguaucg

SEQ ID NO: 1966 - RNA, 23 nt, Artificial sequence
  specific aptamers
ggacgguauggcaugugguaugg

SEQ ID NO: 1967 - RNA, 23 nt, Artificial sequence
  specific aptamers
ggacgguauggcaugugguauug

SEQ ID NO: 1968 - RNA, 22 nt, Artificial sequence
  specific aptamers
ggacgguauggcaugugguaug

SEQ ID NO: 1969 - RNA, 23 nt, Artificial sequence
  specific aptamers
ggacgguaugguaugugguaaag

SEQ ID NO: 1970 - RNA, 23 nt, Artificial sequence
  specific aptamers
ggacgguaugguaugugguaacg

SEQ ID NO: 1971 - RNA, 23 nt, Artificial sequence
  specific aptamers
ggacgguaugguaugugguaagg

SEQ ID NO: 1972 - RNA, 23 nt, Artificial sequence
  specific aptamers
ggacgguaugguaugugguaaug

SEQ ID NO: 1973 - RNA, 22 nt, Artificial sequence
  specific aptamers
ggacgguaugguaugugguaag

SEQ ID NO: 1974 - RNA, 23 nt, Artificial sequence
  specific aptamers
ggacgguaugguaugugguacag

SEQ ID NO: 1975 - RNA, 23 nt, Artificial sequence
  specific aptamers
ggacgguaugguaugugguaccg

SEQ ID NO: 1976 - RNA, 23 nt, Artificial sequence
  specific aptamers
ggacgguaugguaugugguacgg

SEQ ID NO: 1977 - RNA, 23 nt, Artificial sequence
  specific aptamers
ggacgguaugguaugugguacug

SEQ ID NO: 1978 - RNA, 22 nt, Artificial sequence
  specific aptamers
ggacgguaugguaugugguacg

SEQ ID NO: 1979 - RNA, 23 nt, Artificial sequence
  specific aptamers
ggacgguaugguaugugguagag

SEQ ID NO: 1980 - RNA, 23 nt, Artificial sequence
  specific aptamers
ggacgguaugguaugugguagcg

SEQ ID NO: 1981 - RNA, 23 nt, Artificial sequence
  specific aptamers
ggacgguaugguaugugguaggg

SEQ ID NO: 1982 - RNA, 23 nt, Artificial sequence
  specific aptamers
ggacgguaugguaugugguagug

SEQ ID NO: 1983 - RNA, 22 nt, Artificial sequence
  specific aptamers
ggacgguaugguaugugguagg

SEQ ID NO: 1984 - RNA, 23 nt, Artificial sequence
  specific aptamers
ggacgguaugguaugugguauag

SEQ ID NO: 1985 - RNA, 23 nt, Artificial sequence
  specific aptamers
ggacgguaugguaugugguaucg

SEQ ID NO: 1986 - RNA, 23 nt, Artificial sequence
  specific aptamers
ggacgguaugguaugugguaugg

SEQ ID NO: 1987 - RNA, 23 nt, Artificial sequence
  specific aptamers
ggacgguaugguaugugguauug

SEQ ID NO: 1988 - RNA, 22 nt, Artificial sequence
  specific aptamers
ggacgguaugguaugugguaug

SEQ ID NO: 1989 - RNA, 23 nt, Artificial sequence
  specific aptamers
ggacgguuuggaaugugguaaag

SEQ ID NO: 1990 - RNA, 23 nt, Artificial sequence
  specific aptamers
ggacgguuuggaaugugguaacg

SEQ ID NO: 1991 - RNA, 23 nt, Artificial sequence
  specific aptamers
ggacgguuuggaaugugguaagg

SEQ ID NO: 1992 - RNA, 23 nt, Artificial sequence
  specific aptamers
ggacgguuuggaaugugguaaug

SEQ ID NO: 1993 - RNA, 22 nt, Artificial sequence
  specific aptamers
ggacgguuuggaaugugguaag

SEQ ID NO: 1994 - RNA, 23 nt, Artificial sequence
  specific aptamers
ggacgguuuggaaugugguacag

SEQ ID NO: 1995 - RNA, 23 nt, Artificial sequence
  specific aptamers
ggacgguuuggaaugugguaccg

SEQ ID NO: 1996 - RNA, 23 nt, Artificial sequence
  specific aptamers
ggacgguuuggaaugugguacgg

SEQ ID NO: 1997 - RNA, 23 nt, Artificial sequence
  specific aptamers
ggacgguuuggaaugugguacug

SEQ ID NO: 1998 - RNA, 22 nt, Artificial sequence
  specific aptamers
ggacgguuuggaaugugguacg

SEQ ID NO: 1999 - RNA, 23 nt, Artificial sequence
  specific aptamers
ggacgguuuggaaugugguagag

SEQ ID NO: 2000 - RNA, 23 nt, Artificial sequence
  specific aptamers
ggacgguuuggaaugugguagcg

SEQ ID NO: 2001 - RNA, 23 nt, Artificial sequence
  specific aptamers
ggacgguuuggaaugugguaggg

SEQ ID NO: 2002 - RNA, 23 nt, Artificial sequence
  specific aptamers
ggacgguuuggaaugugguagug

SEQ ID NO: 2003 - RNA, 22 nt, Artificial sequence
  specific aptamers
ggacgguuuggaaugugguagg

SEQ ID NO: 2004 - RNA, 23 nt, Artificial sequence
  specific aptamers
ggacgguuuggaaugugguauag

SEQ ID NO: 2005 - RNA, 23 nt, Artificial sequence
  specific aptamers
ggacgguuuggaaugugguaucg

SEQ ID NO: 2006 - RNA, 23 nt, Artificial sequence
  specific aptamers
ggacgguuuggaaugugguaugg

SEQ ID NO: 2007 - RNA, 23 nt, Artificial sequence
  specific aptamers
ggacgguuuggaaugugguauug

SEQ ID NO: 2008 - RNA, 22 nt, Artificial sequence
  specific aptamers
ggacgguuuggaaugugguaug

SEQ ID NO: 2009 - RNA, 23 nt, Artificial sequence
  specific aptamers
ggacgguuuggcaugugguaaag

SEQ ID NO: 2010 - RNA, 23 nt, Artificial sequence
  specific aptamers
ggacgguuuggcaugugguaacg

SEQ ID NO: 2011 - RNA, 23 nt, Artificial sequence
  specific aptamers
ggacgguuuggcaugugguaagg

SEQ ID NO: 2012 - RNA, 23 nt, Artificial sequence
  specific aptamers
ggacgguuuggcaugugguaaug

SEQ ID NO: 2013 - RNA, 22 nt, Artificial sequence
  specific aptamers
ggacgguuuggcaugugguaag

SEQ ID NO: 2014 - RNA, 23 nt, Artificial sequence
  specific aptamers
ggacgguuuggcaugugguacag

SEQ ID NO: 2015 - RNA, 23 nt, Artificial sequence
  specific aptamers
ggacgguuuggcaugugguaccg

SEQ ID NO: 2016 - RNA, 23 nt, Artificial sequence
  specific aptamers
ggacgguuuggcaugugguacgg

SEQ ID NO: 2017 - RNA, 23 nt, Artificial sequence
  specific aptamers
ggacgguuuggcaugugguacug

SEQ ID NO: 2018 - RNA, 22 nt, Artificial sequence
  specific aptamers
ggacgguuuggcaugugguacg

SEQ ID NO: 2019 - RNA, 23 nt, Artificial sequence
  specific aptamers
ggacgguuuggcaugugguagag

SEQ ID NO: 2020 - RNA, 23 nt, Artificial sequence
  specific aptamers
ggacgguuuggcaugugguagcg

SEQ ID NO: 2021 - RNA, 23 nt, Artificial sequence
  specific aptamers
ggacgguuuggcaugugguaggg

SEQ ID NO: 2022 - RNA, 23 nt, Artificial sequence
  specific aptamers
ggacgguuuggcaugugguagug

SEQ ID NO: 2023 - RNA, 22 nt, Artificial sequence
  specific aptamers
ggacgguuuggcaugugguagg

SEQ ID NO: 2024 - RNA, 23 nt, Artificial sequence
  specific aptamers
ggacgguuuggcaugugguauag

SEQ ID NO: 2025 - RNA, 23 nt, Artificial sequence
  specific aptamers
ggacgguuuggcaugugguaucg

SEQ ID NO: 2026 - RNA, 23 nt, Artificial sequence
  specific aptamers
ggacgguuuggcaugugguaugg

SEQ ID NO: 2027 - RNA, 23 nt, Artificial sequence
  specific aptamers
ggacgguuuggcaugugguauug

SEQ ID NO: 2028 - RNA, 22 nt, Artificial sequence
  specific aptamers
ggacgguuuggcaugugguaug

SEQ ID NO: 2029 - RNA, 23 nt, Artificial sequence
  specific aptamers
ggacgguuugguaugugguaaag

SEQ ID NO: 2030 - RNA, 23 nt, Artificial sequence
  specific aptamers
ggacgguuugguaugugguaacg

SEQ ID NO: 2031 - RNA, 23 nt, Artificial sequence
  specific aptamers
ggacgguuugguaugugguaagg

SEQ ID NO: 2032 - RNA, 23 nt, Artificial sequence
  specific aptamers
ggacgguuugguaugugguaaug

SEQ ID NO: 2033 - RNA, 22 nt, Artificial sequence
  specific aptamers
ggacgguuugguaugugguaag

SEQ ID NO: 2034 - RNA, 23 nt, Artificial sequence
  specific aptamers
ggacgguuugguaugugguacag

SEQ ID NO: 2035 - RNA, 23 nt, Artificial sequence
  specific aptamers
ggacgguuugguaugugguaccg

SEQ ID NO: 2036 - RNA, 23 nt, Artificial sequence
  specific aptamers
ggacgguuugguaugugguacgg

SEQ ID NO: 2037 - RNA, 23 nt, Artificial sequence
  specific aptamers
ggacgguuugguaugugguacug

SEQ ID NO: 2038 - RNA, 22 nt, Artificial sequence
  specific aptamers
ggacgguuugguaugugguacg

SEQ ID NO: 2039 - RNA, 23 nt, Artificial sequence
  specific aptamers
ggacgguuugguaugugguagag

SEQ ID NO: 2040 - RNA, 23 nt, Artificial sequence
  specific aptamers
ggacgguuugguaugugguagcg

SEQ ID NO: 2041 - RNA, 23 nt, Artificial sequence
  specific aptamers
ggacgguuugguaugugguaggg

SEQ ID NO: 2042 - RNA, 23 nt, Artificial sequence
  specific aptamers
ggacgguuugguaugugguagug

SEQ ID NO: 2043 - RNA, 22 nt, Artificial sequence
  specific aptamers
ggacgguuugguaugugguagg

SEQ ID NO: 2044 - RNA, 23 nt, Artificial sequence
  specific aptamers
ggacgguuugguaugugguauag

SEQ ID NO: 2045 - RNA, 23 nt, Artificial sequence
  specific aptamers
ggacgguuugguaugugguaucg

SEQ ID NO: 2046 - RNA, 23 nt, Artificial sequence
  specific aptamers
ggacgguuugguaugugguaugg

SEQ ID NO: 2047 - RNA, 23 nt, Artificial sequence
  specific aptamers
ggacgguuugguaugugguauug

SEQ ID NO: 2048 - RNA, 22 nt, Artificial sequence
  specific aptamers
ggacgguuugguaugugguaug

SEQ ID NO: 2049 - RNA, 23 nt, Artificial sequence
  specific aptamers
ggucgguauggaaugugguaaag

SEQ ID NO: 2050 - RNA, 23 nt, Artificial sequence
  specific aptamers
ggucgguauggaaugugguaacg

SEQ ID NO: 2051 - RNA, 23 nt, Artificial sequence
  specific aptamers
ggucgguauggaaugugguaagg

SEQ ID NO: 2052 - RNA, 23 nt, Artificial sequence
  specific aptamers
ggucgguauggaaugugguaaug

SEQ ID NO: 2053 - RNA, 22 nt, Artificial sequence
  specific aptamers
ggucgguauggaaugugguaag

SEQ ID NO: 2054 - RNA, 23 nt, Artificial sequence
  specific aptamers
ggucgguauggaaugugguacag

SEQ ID NO: 2055 - RNA, 23 nt, Artificial sequence
  specific aptamers
ggucgguauggaaugugguaccg

SEQ ID NO: 2056 - RNA, 23 nt, Artificial sequence
  specific aptamers
ggucgguauggaaugugguacgg

SEQ ID NO: 2057 - RNA, 23 nt, Artificial sequence
  specific aptamers
ggucgguauggaaugugguacug

SEQ ID NO: 2058 - RNA, 22 nt, Artificial sequence
  specific aptamers
ggucgguauggaaugugguacg

SEQ ID NO: 2059 - RNA, 23 nt, Artificial sequence
  specific aptamers
ggucgguauggaaugugguagag

SEQ ID NO: 2060 - RNA, 23 nt, Artificial sequence
  specific aptamers
ggucgguauggaaugugguagcg

SEQ ID NO: 2061 - RNA, 23 nt, Artificial sequence
  specific aptamers
ggucgguauggaaugugguaggg

SEQ ID NO: 2062 - RNA, 23 nt, Artificial sequence
  specific aptamers
ggucgguauggaaugugguagug

SEQ ID NO: 2063 - RNA, 22 nt, Artificial sequence
  specific aptamers
ggucgguauggaaugugguagg

SEQ ID NO: 2064 - RNA, 23 nt, Artificial sequence
  specific aptamers
ggucgguauggaaugugguauag

SEQ ID NO: 2065 - RNA, 23 nt, Artificial sequence
  specific aptamers
ggucgguauggaaugugguaucg

SEQ ID NO: 2066 - RNA, 23 nt, Artificial sequence
  specific aptamers
ggucgguauggaaugugguaugg

SEQ ID NO: 2067 - RNA, 23 nt, Artificial sequence
  specific aptamers
ggucgguauggaaugugguauug

SEQ ID NO: 2068 - RNA, 22 nt, Artificial sequence
  specific aptamers
ggucgguauggaaugugguaug

SEQ ID NO: 2069 - RNA, 23 nt, Artificial sequence
  specific aptamers
ggucgguauggcaugugguaaag

SEQ ID NO: 2070 - RNA, 23 nt, Artificial sequence
  specific aptamers
ggucgguauggcaugugguaacg

SEQ ID NO: 2071 - RNA, 23 nt, Artificial sequence
  specific aptamers
ggucgguauggcaugugguaagg

SEQ ID NO: 2072 - RNA, 23 nt, Artificial sequence
  specific aptamers
ggucgguauggcaugugguaaug

SEQ ID NO: 2073 - RNA, 22 nt, Artificial sequence
  specific aptamers
ggucgguauggcaugugguaag

SEQ ID NO: 2074 - RNA, 23 nt, Artificial sequence
  specific aptamers
ggucgguauggcaugugguacag

SEQ ID NO: 2075 - RNA, 23 nt, Artificial sequence
  specific aptamers
ggucgguauggcaugugguaccg

SEQ ID NO: 2076 - RNA, 23 nt, Artificial sequence
  specific aptamers
ggucgguauggcaugugguacgg

SEQ ID NO: 2077 - RNA, 23 nt, Artificial sequence
  specific aptamers
ggucgguauggcaugugguacug

SEQ ID NO: 2078 - RNA, 22 nt, Artificial sequence
  specific aptamers
ggucgguauggcaugugguacg

SEQ ID NO: 2079 - RNA, 23 nt, Artificial sequence
  specific aptamers
ggucgguauggcaugugguagag

SEQ ID NO: 2080 - RNA, 23 nt, Artificial sequence
  specific aptamers
ggucgguauggcaugugguagcg

SEQ ID NO: 2081 - RNA, 23 nt, Artificial sequence
  specific aptamers
ggucgguauggcaugugguaggg

SEQ ID NO: 2082 - RNA, 23 nt, Artificial sequence
  specific aptamers
ggucgguauggcaugugguagug

SEQ ID NO: 2083 - RNA, 22 nt, Artificial sequence
  specific aptamers
ggucgguauggcaugugguagg

SEQ ID NO: 2084 - RNA, 23 nt, Artificial sequence
  specific aptamers
ggucgguauggcaugugguauag

SEQ ID NO: 2085 - RNA, 23 nt, Artificial sequence
  specific aptamers
ggucgguauggcaugugguaucg

SEQ ID NO: 2086 - RNA, 23 nt, Artificial sequence
  specific aptamers
ggucgguauggcaugugguaugg

SEQ ID NO: 2087 - RNA, 23 nt, Artificial sequence
  specific aptamers
ggucgguauggcaugugguauug

SEQ ID NO: 2088 - RNA, 22 nt, Artificial sequence
  specific aptamers
ggucgguauggcaugugguaug

SEQ ID NO: 2089 - RNA, 23 nt, Artificial sequence
  specific aptamers
ggucgguaugguaugugguaaag

SEQ ID NO: 2090 - RNA, 23 nt, Artificial sequence
  specific aptamers
ggucgguaugguaugugguaacg

SEQ ID NO: 2091 - RNA, 23 nt, Artificial sequence
  specific aptamers
ggucgguaugguaugugguaagg

SEQ ID NO: 2092 - RNA, 23 nt, Artificial sequence
  specific aptamers
ggucgguaugguaugugguaaug

SEQ ID NO: 2093 - RNA, 22 nt, Artificial sequence
  specific aptamers
ggucgguaugguaugugguaag

SEQ ID NO: 2094 - RNA, 23 nt, Artificial sequence
  specific aptamers
ggucgguaugguaugugguacag

SEQ ID NO: 2095 - RNA, 23 nt, Artificial sequence
  specific aptamers
ggucgguaugguaugugguaccg

SEQ ID NO: 2096 - RNA, 23 nt, Artificial sequence
  specific aptamers
ggucgguaugguaugugguacgg

SEQ ID NO: 2097 - RNA, 23 nt, Artificial sequence
  specific aptamers
ggucgguaugguaugugguacug

SEQ ID NO: 2098 - RNA, 22 nt, Artificial sequence
  specific aptamers
ggucgguaugguaugugguacg

SEQ ID NO: 2099 - RNA, 23 nt, Artificial sequence
  specific aptamers
ggucgguaugguaugugguagag

SEQ ID NO: 2100 - RNA, 23 nt, Artificial sequence
  specific aptamers
ggucgguaugguaugugguagcg

SEQ ID NO: 2101 - RNA, 23 nt, Artificial sequence
  specific aptamers
ggucgguaugguaugugguaggg

SEQ ID NO: 2102 - RNA, 23 nt, Artificial sequence
  specific aptamers
ggucgguaugguaugugguagug

SEQ ID NO: 2103 - RNA, 22 nt, Artificial sequence
  specific aptamers
ggucgguaugguaugugguagg

SEQ ID NO: 2104 - RNA, 23 nt, Artificial sequence
  specific aptamers
ggucgguaugguaugugguauag

SEQ ID NO: 2105 - RNA, 23 nt, Artificial sequence
  specific aptamers
ggucgguaugguaugugguaucg

SEQ ID NO: 2106 - RNA, 23 nt, Artificial sequence
  specific aptamers
ggucgguaugguaugugguaugg

SEQ ID NO: 2107 - RNA, 23 nt, Artificial sequence
  specific aptamers
ggucgguaugguaugugguauug

SEQ ID NO: 2108 - RNA, 22 nt, Artificial sequence
  specific aptamers
ggucgguaugguaugugguaug

SEQ ID NO: 2109 - RNA, 23 nt, Artificial sequence
  specific aptamers
ggucgguuuggaaugugguaaag

SEQ ID NO: 2110 - RNA, 23 nt, Artificial sequence
  specific aptamers
ggucgguuuggaaugugguaacg

SEQ ID NO: 2111 - RNA, 23 nt, Artificial sequence
  specific aptamers
ggucgguuuggaaugugguaagg

SEQ ID NO: 2112 - RNA, 23 nt, Artificial sequence
  specific aptamers
ggucgguuuggaaugugguaaug

SEQ ID NO: 2113 - RNA, 22 nt, Artificial sequence
  specific aptamers
ggucgguuuggaaugugguaag

SEQ ID NO: 2114 - RNA, 23 nt, Artificial sequence
  specific aptamers
ggucgguuuggaaugugguacag

SEQ ID NO: 2115 - RNA, 23 nt, Artificial sequence
  specific aptamers
ggucgguuuggaaugugguaccg

SEQ ID NO: 2116 - RNA, 23 nt, Artificial sequence
  specific aptamers
ggucgguuuggaaugugguacgg

SEQ ID NO: 2117 - RNA, 23 nt, Artificial sequence
  specific aptamers
ggucgguuuggaaugugguacug

SEQ ID NO: 2118 - RNA, 22 nt, Artificial sequence
  specific aptamers
ggucgguuuggaaugugguacg

SEQ ID NO: 2119 - RNA, 23 nt, Artificial sequence
  specific aptamers
ggucgguuuggaaugugguagag

SEQ ID NO: 2120 - RNA, 23 nt, Artificial sequence
  specific aptamers
ggucgguuuggaaugugguagcg

SEQ ID NO: 2121 - RNA, 23 nt, Artificial sequence
  specific aptamers
ggucgguuuggaaugugguaggg

SEQ ID NO: 2122 - RNA, 23 nt, Artificial sequence
  specific aptamers
ggucgguuuggaaugugguagug

SEQ ID NO: 2123 - RNA, 22 nt, Artificial sequence
  specific aptamers
ggucgguuuggaaugugguagg

SEQ ID NO: 2124 - RNA, 23 nt, Artificial sequence
  specific aptamers
ggucgguuuggaaugugguauag

SEQ ID NO: 2125 - RNA, 23 nt, Artificial sequence
  specific aptamers
ggucgguuuggaaugugguaucg

SEQ ID NO: 2126 - RNA, 23 nt, Artificial sequence
  specific aptamers
ggucgguuuggaaugugguaugg

SEQ ID NO: 2127 - RNA, 23 nt, Artificial sequence
  specific aptamers
ggucgguuuggaaugugguauug

SEQ ID NO: 2128 - RNA, 22 nt, Artificial sequence
  specific aptamers
ggucgguuuggaaugugguaug

SEQ ID NO: 2129 - RNA, 23 nt, Artificial sequence
  specific aptamers
ggucgguuuggcaugugguaaag

SEQ ID NO: 2130 - RNA, 23 nt, Artificial sequence
  specific aptamers
ggucgguuuggcaugugguaacg

SEQ ID NO: 2131 - RNA, 23 nt, Artificial sequence
  specific aptamers
ggucgguuuggcaugugguaagg

SEQ ID NO: 2132 - RNA, 23 nt, Artificial sequence
  specific aptamers
ggucgguuuggcaugugguaaug

SEQ ID NO: 2133 - RNA, 22 nt, Artificial sequence
  specific aptamers
ggucgguuuggcaugugguaag

SEQ ID NO: 2134 - RNA, 23 nt, Artificial sequence
  specific aptamers
ggucgguuuggcaugugguacag

SEQ ID NO: 2135 - RNA, 23 nt, Artificial sequence
  specific aptamers
ggucgguuuggcaugugguaccg

SEQ ID NO: 2136 - RNA, 23 nt, Artificial sequence
  specific aptamers
ggucgguuuggcaugugguacgg

SEQ ID NO: 2137 - RNA, 23 nt, Artificial sequence
  specific aptamers
ggucgguuuggcaugugguacug

SEQ ID NO: 2138 - RNA, 22 nt, Artificial sequence
  specific aptamers
ggucgguuuggcaugugguacg

SEQ ID NO: 2139 - RNA, 23 nt, Artificial sequence
  specific aptamers
ggucgguuuggcaugugguagag

SEQ ID NO: 2140 - RNA, 23 nt, Artificial sequence
  specific aptamers
ggucgguuuggcaugugguagcg

SEQ ID NO: 2141 - RNA, 23 nt, Artificial sequence
  specific aptamers
ggucgguuuggcaugugguaggg

SEQ ID NO: 2142 - RNA, 23 nt, Artificial sequence
  specific aptamers
ggucgguuuggcaugugguagug

SEQ ID NO: 2143 - RNA, 22 nt, Artificial sequence
  specific aptamers
ggucgguuuggcaugugguagg

SEQ ID NO: 2144 - RNA, 23 nt, Artificial sequence
  specific aptamers
ggucgguuuggcaugugguauag

SEQ ID NO: 2145 - RNA, 23 nt, Artificial sequence
  specific aptamers
ggucgguuuggcaugugguaucg

SEQ ID NO: 2146 - RNA, 23 nt, Artificial sequence
  specific aptamers
ggucgguuuggcaugugguaugg

SEQ ID NO: 2147 - RNA, 23 nt, Artificial sequence
  specific aptamers
ggucgguuuggcaugugguauug

SEQ ID NO: 2148 - RNA, 22 nt, Artificial sequence
  specific aptamers
ggucgguuuggcaugugguaug

SEQ ID NO: 2149 - RNA, 23 nt, Artificial sequence
  specific aptamers
ggucgguuugguaugugguaaag

SEQ ID NO: 2150 - RNA, 23 nt, Artificial sequence
  specific aptamers
ggucgguuugguaugugguaacg

SEQ ID NO: 2151 - RNA, 23 nt, Artificial sequence
  specific aptamers
ggucgguuugguaugugguaagg

SEQ ID NO: 2152 - RNA, 23 nt, Artificial sequence
  specific aptamers
ggucgguuugguaugugguaaug

SEQ ID NO: 2153 - RNA, 22 nt, Artificial sequence
  specific aptamers
ggucgguuugguaugugguaag

SEQ ID NO: 2154 - RNA, 23 nt, Artificial sequence
  specific aptamers
ggucgguuugguaugugguacag

SEQ ID NO: 2155 - RNA, 23 nt, Artificial sequence
  specific aptamers
ggucgguuugguaugugguaccg

SEQ ID NO: 2156 - RNA, 23 nt, Artificial sequence
  specific aptamers
ggucgguuugguaugugguacgg

SEQ ID NO: 2157 - RNA, 23 nt, Artificial sequence
  specific aptamers
ggucgguuugguaugugguacug

SEQ ID NO: 2158 - RNA, 22 nt, Artificial sequence
  specific aptamers
ggucgguuugguaugugguacg

SEQ ID NO: 2159 - RNA, 23 nt, Artificial sequence
  specific aptamers
ggucgguuugguaugugguagag

SEQ ID NO: 2160 - RNA, 23 nt, Artificial sequence
  specific aptamers
ggucgguuugguaugugguagcg

SEQ ID NO: 2161 - RNA, 23 nt, Artificial sequence
  specific aptamers
ggucgguuugguaugugguaggg

SEQ ID NO: 2162 - RNA, 23 nt, Artificial sequence
  specific aptamers
ggucgguuugguaugugguagug

SEQ ID NO: 2163 - RNA, 22 nt, Artificial sequence
  specific aptamers
ggucgguuugguaugugguagg

SEQ ID NO: 2164 - RNA, 23 nt, Artificial sequence
  specific aptamers
ggucgguuugguaugugguauag

SEQ ID NO: 2165 - RNA, 23 nt, Artificial sequence
  specific aptamers
ggucgguuugguaugugguaucg

SEQ ID NO: 2166 - RNA, 23 nt, Artificial sequence
  specific aptamers
ggucgguuugguaugugguaugg

SEQ ID NO: 2167 - RNA, 23 nt, Artificial sequence
  specific aptamers
ggucgguuugguaugugguauug

SEQ ID NO: 2168 - RNA, 22 nt, Artificial sequence
  specific aptamers
ggucgguuugguaugugguaug

SEQ ID NO: 2169 - RNA, 23 nt, Artificial sequence
  specific aptamers
ggaagguauggaaugagguaaau

SEQ ID NO: 2170 - RNA, 23 nt, Artificial sequence
  specific aptamers
ggaagguauggaaugagguaacu

SEQ ID NO: 2171 - RNA, 23 nt, Artificial sequence
  specific aptamers
ggaagguauggaaugagguaagu

SEQ ID NO: 2172 - RNA, 23 nt, Artificial sequence
  specific aptamers
ggaagguauggaaugagguaauu

SEQ ID NO: 2173 - RNA, 22 nt, Artificial sequence
  specific aptamers
ggaagguauggaaugagguaau

SEQ ID NO: 2174 - RNA, 23 nt, Artificial sequence
  specific aptamers
ggaagguauggaaugagguacau

SEQ ID NO: 2175 - RNA, 23 nt, Artificial sequence
  specific aptamers
ggaagguauggaaugagguaccu

SEQ ID NO: 2176 - RNA, 23 nt, Artificial sequence
  specific aptamers
ggaagguauggaaugagguacgu

SEQ ID NO: 2177 - RNA, 23 nt, Artificial sequence
  specific aptamers
ggaagguauggaaugagguacuu

SEQ ID NO: 2178 - RNA, 22 nt, Artificial sequence
  specific aptamers
ggaagguauggaaugagguacu

SEQ ID NO: 2179 - RNA, 23 nt, Artificial sequence
  specific aptamers
ggaagguauggaaugagguagau

SEQ ID NO: 2180 - RNA, 23 nt, Artificial sequence
  specific aptamers
ggaagguauggaaugagguagcu

SEQ ID NO: 2181 - RNA, 23 nt, Artificial sequence
  specific aptamers
ggaagguauggaaugagguaggu

SEQ ID NO: 2182 - RNA, 23 nt, Artificial sequence
  specific aptamers
ggaagguauggaaugagguaguu

SEQ ID NO: 2183 - RNA, 22 nt, Artificial sequence
  specific aptamers
ggaagguauggaaugagguagu

SEQ ID NO: 2184 - RNA, 23 nt, Artificial sequence
  specific aptamers
ggaagguauggaaugagguauau

SEQ ID NO: 2185 - RNA, 23 nt, Artificial sequence
  specific aptamers
ggaagguauggaaugagguaucu

SEQ ID NO: 2186 - RNA, 23 nt, Artificial sequence
  specific aptamers
ggaagguauggaaugagguaugu

SEQ ID NO: 2187 - RNA, 23 nt, Artificial sequence
  specific aptamers
ggaagguauggaaugagguauuu

SEQ ID NO: 2188 - RNA, 22 nt, Artificial sequence
  specific aptamers
ggaagguauggaaugagguauu

SEQ ID NO: 2189 - RNA, 23 nt, Artificial sequence
  specific aptamers
ggaagguauggcaugagguaaau

SEQ ID NO: 2190 - RNA, 23 nt, Artificial sequence
  specific aptamers
ggaagguauggcaugagguaacu

SEQ ID NO: 2191 - RNA, 23 nt, Artificial sequence
  specific aptamers
ggaagguauggcaugagguaagu

SEQ ID NO: 2192 - RNA, 23 nt, Artificial sequence
  specific aptamers
ggaagguauggcaugagguaauu

SEQ ID NO: 2193 - RNA, 22 nt, Artificial sequence
  specific aptamers
ggaagguauggcaugagguaau

SEQ ID NO: 2194 - RNA, 23 nt, Artificial sequence
  specific aptamers
ggaagguauggcaugagguacau

SEQ ID NO: 2195 - RNA, 23 nt, Artificial sequence
  specific aptamers
ggaagguauggcaugagguaccu

SEQ ID NO: 2196 - RNA, 23 nt, Artificial sequence
  specific aptamers
ggaagguauggcaugagguacgu

SEQ ID NO: 2197 - RNA, 23 nt, Artificial sequence
  specific aptamers
ggaagguauggcaugagguacuu

SEQ ID NO: 2198 - RNA, 22 nt, Artificial sequence
  specific aptamers
ggaagguauggcaugagguacu

SEQ ID NO: 2199 - RNA, 23 nt, Artificial sequence
  specific aptamers
ggaagguauggcaugagguagau

SEQ ID NO: 2200 - RNA, 23 nt, Artificial sequence
  specific aptamers
ggaagguauggcaugagguagcu

SEQ ID NO: 2201 - RNA, 23 nt, Artificial sequence
  specific aptamers
ggaagguauggcaugagguaggu

SEQ ID NO: 2202 - RNA, 23 nt, Artificial sequence
  specific aptamers
ggaagguauggcaugagguaguu

SEQ ID NO: 2203 - RNA, 22 nt, Artificial sequence
  specific aptamers
ggaagguauggcaugagguagu

SEQ ID NO: 2204 - RNA, 23 nt, Artificial sequence
  specific aptamers
ggaagguauggcaugagguauau

SEQ ID NO: 2205 - RNA, 23 nt, Artificial sequence
  specific aptamers
ggaagguauggcaugagguaucu

SEQ ID NO: 2206 - RNA, 23 nt, Artificial sequence
  specific aptamers
ggaagguauggcaugagguaugu

SEQ ID NO: 2207 - RNA, 23 nt, Artificial sequence
  specific aptamers
ggaagguauggcaugagguauuu

SEQ ID NO: 2208 - RNA, 22 nt, Artificial sequence
  specific aptamers
ggaagguauggcaugagguauu

SEQ ID NO: 2209 - RNA, 23 nt, Artificial sequence
  specific aptamers
ggaagguaugguaugagguaaau

SEQ ID NO: 2210 - RNA, 23 nt, Artificial sequence
  specific aptamers
ggaagguaugguaugagguaacu

SEQ ID NO: 2211 - RNA, 23 nt, Artificial sequence
  specific aptamers
ggaagguaugguaugagguaagu

SEQ ID NO: 2212 - RNA, 23 nt, Artificial sequence
  specific aptamers
ggaagguaugguaugagguaauu

SEQ ID NO: 2213 - RNA, 22 nt, Artificial sequence
  specific aptamers
ggaagguaugguaugagguaau

SEQ ID NO: 2214 - RNA, 23 nt, Artificial sequence
  specific aptamers
ggaagguaugguaugagguacau

SEQ ID NO: 2215 - RNA, 23 nt, Artificial sequence
  specific aptamers
ggaagguaugguaugagguaccu

SEQ ID NO: 2216 - RNA, 23 nt, Artificial sequence
  specific aptamers
ggaagguaugguaugagguacgu

SEQ ID NO: 2217 - RNA, 23 nt, Artificial sequence
  specific aptamers
ggaagguaugguaugagguacuu

SEQ ID NO: 2218 - RNA, 22 nt, Artificial sequence
  specific aptamers
ggaagguaugguaugagguacu

SEQ ID NO: 2219 - RNA, 23 nt, Artificial sequence
  specific aptamers
ggaagguaugguaugagguagau

SEQ ID NO: 2220 - RNA, 23 nt, Artificial sequence
  specific aptamers
ggaagguaugguaugagguagcu

SEQ ID NO: 2221 - RNA, 23 nt, Artificial sequence
  specific aptamers
ggaagguaugguaugagguaggu

SEQ ID NO: 2222 - RNA, 23 nt, Artificial sequence
  specific aptamers
ggaagguaugguaugagguaguu

SEQ ID NO: 2223 - RNA, 22 nt, Artificial sequence
  specific aptamers
ggaagguaugguaugagguagu

SEQ ID NO: 2224 - RNA, 23 nt, Artificial sequence
  specific aptamers
ggaagguaugguaugagguauau

SEQ ID NO: 2225 - RNA, 23 nt, Artificial sequence
  specific aptamers
ggaagguaugguaugagguaucu

SEQ ID NO: 2226 - RNA, 23 nt, Artificial sequence
  specific aptamers
ggaagguaugguaugagguaugu

SEQ ID NO: 2227 - RNA, 23 nt, Artificial sequence
  specific aptamers
ggaagguaugguaugagguauuu

SEQ ID NO: 2228 - RNA, 22 nt, Artificial sequence
  specific aptamers
ggaagguaugguaugagguauu

SEQ ID NO: 2229 - RNA, 23 nt, Artificial sequence
  specific aptamers
ggaagguuuggaaugagguaaau

SEQ ID NO: 2230 - RNA, 23 nt, Artificial sequence
  specific aptamers
ggaagguuuggaaugagguaacu

SEQ ID NO: 2231 - RNA, 23 nt, Artificial sequence
  specific aptamers
ggaagguuuggaaugagguaagu

SEQ ID NO: 2232 - RNA, 23 nt, Artificial sequence
  specific aptamers
ggaagguuuggaaugagguaauu

SEQ ID NO: 2233 - RNA, 22 nt, Artificial sequence
  specific aptamers
ggaagguuuggaaugagguaau

SEQ ID NO: 2234 - RNA, 23 nt, Artificial sequence
  specific aptamers
ggaagguuuggaaugagguacau

SEQ ID NO: 2235 - RNA, 23 nt, Artificial sequence
  specific aptamers
ggaagguuuggaaugagguaccu

SEQ ID NO: 2236 - RNA, 23 nt, Artificial sequence
  specific aptamers
ggaagguuuggaaugagguacgu

SEQ ID NO: 2237 - RNA, 23 nt, Artificial sequence
  specific aptamers
ggaagguuuggaaugagguacuu

SEQ ID NO: 2238 - RNA, 22 nt, Artificial sequence
  specific aptamers
ggaagguuuggaaugagguacu

SEQ ID NO: 2239 - RNA, 23 nt, Artificial sequence
  specific aptamers
ggaagguuuggaaugagguagau

SEQ ID NO: 2240 - RNA, 23 nt, Artificial sequence
  specific aptamers
ggaagguuuggaaugagguagcu

SEQ ID NO: 2241 - RNA, 23 nt, Artificial sequence
  specific aptamers
ggaagguuuggaaugagguaggu

SEQ ID NO: 2242 - RNA, 23 nt, Artificial sequence
  specific aptamers
ggaagguuuggaaugagguaguu

SEQ ID NO: 2243 - RNA, 22 nt, Artificial sequence
  specific aptamers
ggaagguuuggaaugagguagu

SEQ ID NO: 2244 - RNA, 23 nt, Artificial sequence
  specific aptamers
ggaagguuuggaaugagguauau

SEQ ID NO: 2245 - RNA, 23 nt, Artificial sequence
  specific aptamers
ggaagguuuggaaugagguaucu

SEQ ID NO: 2246 - RNA, 23 nt, Artificial sequence
  specific aptamers
ggaagguuuggaaugagguaugu

SEQ ID NO: 2247 - RNA, 23 nt, Artificial sequence
  specific aptamers
ggaagguuuggaaugagguauuu

SEQ ID NO: 2248 - RNA, 22 nt, Artificial sequence
  specific aptamers
ggaagguuuggaaugagguauu

SEQ ID NO: 2249 - RNA, 23 nt, Artificial sequence
  specific aptamers
ggaagguuuggcaugagguaaau

SEQ ID NO: 2250 - RNA, 23 nt, Artificial sequence
  specific aptamers
ggaagguuuggcaugagguaacu

SEQ ID NO: 2251 - RNA, 23 nt, Artificial sequence
  specific aptamers
ggaagguuuggcaugagguaagu

SEQ ID NO: 2252 - RNA, 23 nt, Artificial sequence
  specific aptamers
ggaagguuuggcaugagguaauu

SEQ ID NO: 2253 - RNA, 22 nt, Artificial sequence
  specific aptamers
ggaagguuuggcaugagguaau

SEQ ID NO: 2254 - RNA, 23 nt, Artificial sequence
  specific aptamers
ggaagguuuggcaugagguacau

SEQ ID NO: 2255 - RNA, 23 nt, Artificial sequence
  specific aptamers
ggaagguuuggcaugagguaccu

SEQ ID NO: 2256 - RNA, 23 nt, Artificial sequence
  specific aptamers
ggaagguuuggcaugagguacgu

SEQ ID NO: 2257 - RNA, 23 nt, Artificial sequence
  specific aptamers
ggaagguuuggcaugagguacuu

SEQ ID NO: 2258 - RNA, 22 nt, Artificial sequence
  specific aptamers
ggaagguuuggcaugagguacu

SEQ ID NO: 2259 - RNA, 23 nt, Artificial sequence
  specific aptamers
ggaagguuuggcaugagguagau

SEQ ID NO: 2260 - RNA, 23 nt, Artificial sequence
  specific aptamers
ggaagguuuggcaugagguagcu

SEQ ID NO: 2261 - RNA, 23 nt, Artificial sequence
  specific aptamers
ggaagguuuggcaugagguaggu

SEQ ID NO: 2262 - RNA, 23 nt, Artificial sequence
  specific aptamers
ggaagguuuggcaugagguaguu

SEQ ID NO: 2263 - RNA, 22 nt, Artificial sequence
  specific aptamers
ggaagguuuggcaugagguagu

SEQ ID NO: 2264 - RNA, 23 nt, Artificial sequence
  specific aptamers
ggaagguuuggcaugagguauau

SEQ ID NO: 2265 - RNA, 23 nt, Artificial sequence
  specific aptamers
ggaagguuuggcaugagguaucu

SEQ ID NO: 2266 - RNA, 23 nt, Artificial sequence
  specific aptamers
ggaagguuuggcaugagguaugu

SEQ ID NO: 2267 - RNA, 23 nt, Artificial sequence
  specific aptamers
ggaagguuuggcaugagguauuu

SEQ ID NO: 2268 - RNA, 22 nt, Artificial sequence
  specific aptamers
ggaagguuuggcaugagguauu

SEQ ID NO: 2269 - RNA, 23 nt, Artificial sequence
  specific aptamers
ggaagguuugguaugagguaaau

SEQ ID NO: 2270 - RNA, 23 nt, Artificial sequence
  specific aptamers
ggaagguuugguaugagguaacu

SEQ ID NO: 2271 - RNA, 23 nt, Artificial sequence
  specific aptamers
ggaagguuugguaugagguaagu

SEQ ID NO: 2272 - RNA, 23 nt, Artificial sequence
  specific aptamers
ggaagguuugguaugagguaauu

SEQ ID NO: 2273 - RNA, 22 nt, Artificial sequence
  specific aptamers
ggaagguuugguaugagguaau

SEQ ID NO: 2274 - RNA, 23 nt, Artificial sequence
  specific aptamers
ggaagguuugguaugagguacau

SEQ ID NO: 2275 - RNA, 23 nt, Artificial sequence
  specific aptamers
ggaagguuugguaugagguaccu

SEQ ID NO: 2276 - RNA, 23 nt, Artificial sequence
  specific aptamers
ggaagguuugguaugagguacgu

SEQ ID NO: 2277 - RNA, 23 nt, Artificial sequence
  specific aptamers
ggaagguuugguaugagguacuu

SEQ ID NO: 2278 - RNA, 22 nt, Artificial sequence
  specific aptamers
ggaagguuugguaugagguacu

SEQ ID NO: 2279 - RNA, 23 nt, Artificial sequence
  specific aptamers
ggaagguuugguaugagguagau

SEQ ID NO: 2280 - RNA, 23 nt, Artificial sequence
  specific aptamers
ggaagguuugguaugagguagcu

SEQ ID NO: 2281 - RNA, 23 nt, Artificial sequence
  specific aptamers
ggaagguuugguaugagguaggu

SEQ ID NO: 2282 - RNA, 23 nt, Artificial sequence
  specific aptamers
ggaagguuugguaugagguaguu

SEQ ID NO: 2283 - RNA, 22 nt, Artificial sequence
  specific aptamers
ggaagguuugguaugagguagu

SEQ ID NO: 2284 - RNA, 23 nt, Artificial sequence
  specific aptamers
ggaagguuugguaugagguauau

SEQ ID NO: 2285 - RNA, 23 nt, Artificial sequence
  specific aptamers
ggaagguuugguaugagguaucu

SEQ ID NO: 2286 - RNA, 23 nt, Artificial sequence
  specific aptamers
ggaagguuugguaugagguaugu

SEQ ID NO: 2287 - RNA, 23 nt, Artificial sequence
  specific aptamers
ggaagguuugguaugagguauuu

SEQ ID NO: 2288 - RNA, 22 nt, Artificial sequence
  specific aptamers
ggaagguuugguaugagguauu

SEQ ID NO: 2289 - RNA, 23 nt, Artificial sequence
  specific aptamers
gguagguauggaaugagguaaau

SEQ ID NO: 2290 - RNA, 23 nt, Artificial sequence
  specific aptamers
gguagguauggaaugagguaacu

SEQ ID NO: 2291 - RNA, 23 nt, Artificial sequence
  specific aptamers
gguagguauggaaugagguaagu

SEQ ID NO: 2292 - RNA, 23 nt, Artificial sequence
  specific aptamers
gguagguauggaaugagguaauu

SEQ ID NO: 2293 - RNA, 22 nt, Artificial sequence
  specific aptamers
gguagguauggaaugagguaau

SEQ ID NO: 2294 - RNA, 23 nt, Artificial sequence
  specific aptamers
gguagguauggaaugagguacau

SEQ ID NO: 2295 - RNA, 23 nt, Artificial sequence
  specific aptamers
gguagguauggaaugagguaccu

SEQ ID NO: 2296 - RNA, 23 nt, Artificial sequence
  specific aptamers
gguagguauggaaugagguacgu

SEQ ID NO: 2297 - RNA, 23 nt, Artificial sequence
  specific aptamers
gguagguauggaaugagguacuu

SEQ ID NO: 2298 - RNA, 22 nt, Artificial sequence
  specific aptamers
gguagguauggaaugagguacu

SEQ ID NO: 2299 - RNA, 23 nt, Artificial sequence
  specific aptamers
gguagguauggaaugagguagau

SEQ ID NO: 2300 - RNA, 23 nt, Artificial sequence
  specific aptamers
gguagguauggaaugagguagcu

SEQ ID NO: 2301 - RNA, 23 nt, Artificial sequence
  specific aptamers
gguagguauggaaugagguaggu

SEQ ID NO: 2302 - RNA, 23 nt, Artificial sequence
  specific aptamers
gguagguauggaaugagguaguu

SEQ ID NO: 2303 - RNA, 22 nt, Artificial sequence
  specific aptamers
gguagguauggaaugagguagu

SEQ ID NO: 2304 - RNA, 23 nt, Artificial sequence
  specific aptamers
gguagguauggaaugagguauau

SEQ ID NO: 2305 - RNA, 23 nt, Artificial sequence
  specific aptamers
gguagguauggaaugagguaucu

SEQ ID NO: 2306 - RNA, 23 nt, Artificial sequence
  specific aptamers
gguagguauggaaugagguaugu

SEQ ID NO: 2307 - RNA, 23 nt, Artificial sequence
  specific aptamers
gguagguauggaaugagguauuu

SEQ ID NO: 2308 - RNA, 22 nt, Artificial sequence
  specific aptamers
gguagguauggaaugagguauu

SEQ ID NO: 2309 - RNA, 23 nt, Artificial sequence
  specific aptamers
gguagguauggcaugagguaaau

SEQ ID NO: 2310 - RNA, 23 nt, Artificial sequence
  specific aptamers
gguagguauggcaugagguaacu

SEQ ID NO: 2311 - RNA, 23 nt, Artificial sequence
  specific aptamers
gguagguauggcaugagguaagu

SEQ ID NO: 2312 - RNA, 23 nt, Artificial sequence
  specific aptamers
gguagguauggcaugagguaauu

SEQ ID NO: 2313 - RNA, 22 nt, Artificial sequence
  specific aptamers
gguagguauggcaugagguaau

SEQ ID NO: 2314 - RNA, 23 nt, Artificial sequence
  specific aptamers
gguagguauggcaugagguacau

SEQ ID NO: 2315 - RNA, 23 nt, Artificial sequence
  specific aptamers
gguagguauggcaugagguaccu

SEQ ID NO: 2316 - RNA, 23 nt, Artificial sequence
  specific aptamers
gguagguauggcaugagguacgu

SEQ ID NO: 2317 - RNA, 23 nt, Artificial sequence
  specific aptamers
gguagguauggcaugagguacuu

SEQ ID NO: 2318 - RNA, 22 nt, Artificial sequence
  specific aptamers
gguagguauggcaugagguacu

SEQ ID NO: 2319 - RNA, 23 nt, Artificial sequence
  specific aptamers
gguagguauggcaugagguagau

SEQ ID NO: 2320 - RNA, 23 nt, Artificial sequence
  specific aptamers
gguagguauggcaugagguagcu

SEQ ID NO: 2321 - RNA, 23 nt, Artificial sequence
  specific aptamers
gguagguauggcaugagguaggu

SEQ ID NO: 2322 - RNA, 23 nt, Artificial sequence
  specific aptamers
gguagguauggcaugagguaguu

SEQ ID NO: 2323 - RNA, 22 nt, Artificial sequence
  specific aptamers
gguagguauggcaugagguagu

SEQ ID NO: 2324 - RNA, 23 nt, Artificial sequence
  specific aptamers
gguagguauggcaugagguauau

SEQ ID NO: 2325 - RNA, 23 nt, Artificial sequence
  specific aptamers
gguagguauggcaugagguaucu

SEQ ID NO: 2326 - RNA, 23 nt, Artificial sequence
  specific aptamers
gguagguauggcaugagguaugu

SEQ ID NO: 2327 - RNA, 23 nt, Artificial sequence
  specific aptamers
gguagguauggcaugagguauuu

SEQ ID NO: 2328 - RNA, 22 nt, Artificial sequence
  specific aptamers
gguagguauggcaugagguauu

SEQ ID NO: 2329 - RNA, 23 nt, Artificial sequence
  specific aptamers
gguagguaugguaugagguaaau

SEQ ID NO: 2330 - RNA, 23 nt, Artificial sequence
  specific aptamers
gguagguaugguaugagguaacu

SEQ ID NO: 2331 - RNA, 23 nt, Artificial sequence
  specific aptamers
gguagguaugguaugagguaagu

SEQ ID NO: 2332 - RNA, 23 nt, Artificial sequence
  specific aptamers
gguagguaugguaugagguaauu

SEQ ID NO: 2333 - RNA, 22 nt, Artificial sequence
  specific aptamers
gguagguaugguaugagguaau

SEQ ID NO: 2334 - RNA, 23 nt, Artificial sequence
  specific aptamers
gguagguaugguaugagguacau

SEQ ID NO: 2335 - RNA, 23 nt, Artificial sequence
  specific aptamers
gguagguaugguaugagguaccu

SEQ ID NO: 2336 - RNA, 23 nt, Artificial sequence
  specific aptamers
gguagguaugguaugagguacgu

SEQ ID NO: 2337 - RNA, 23 nt, Artificial sequence
  specific aptamers
gguagguaugguaugagguacuu

SEQ ID NO: 2338 - RNA, 22 nt, Artificial sequence
  specific aptamers
gguagguaugguaugagguacu

SEQ ID NO: 2339 - RNA, 23 nt, Artificial sequence
  specific aptamers
gguagguaugguaugagguagau

SEQ ID NO: 2340 - RNA, 23 nt, Artificial sequence
  specific aptamers
gguagguaugguaugagguagcu

SEQ ID NO: 2341 - RNA, 23 nt, Artificial sequence
  specific aptamers
gguagguaugguaugagguaggu

SEQ ID NO: 2342 - RNA, 23 nt, Artificial sequence
  specific aptamers
gguagguaugguaugagguaguu

SEQ ID NO: 2343 - RNA, 22 nt, Artificial sequence
  specific aptamers
gguagguaugguaugagguagu

SEQ ID NO: 2344 - RNA, 23 nt, Artificial sequence
  specific aptamers
gguagguaugguaugagguauau

SEQ ID NO: 2345 - RNA, 23 nt, Artificial sequence
  specific aptamers
gguagguaugguaugagguaucu

SEQ ID NO: 2346 - RNA, 23 nt, Artificial sequence
  specific aptamers
gguagguaugguaugagguaugu

SEQ ID NO: 2347 - RNA, 23 nt, Artificial sequence
  specific aptamers
gguagguaugguaugagguauuu

SEQ ID NO: 2348 - RNA, 22 nt, Artificial sequence
  specific aptamers
gguagguaugguaugagguauu

SEQ ID NO: 2349 - RNA, 23 nt, Artificial sequence
  specific aptamers
gguagguuuggaaugagguaaau

SEQ ID NO: 2350 - RNA, 23 nt, Artificial sequence
  specific aptamers
gguagguuuggaaugagguaacu

SEQ ID NO: 2351 - RNA, 23 nt, Artificial sequence
  specific aptamers
gguagguuuggaaugagguaagu

SEQ ID NO: 2352 - RNA, 23 nt, Artificial sequence
  specific aptamers
gguagguuuggaaugagguaauu

SEQ ID NO: 2353 - RNA, 22 nt, Artificial sequence
  specific aptamers
gguagguuuggaaugagguaau

SEQ ID NO: 2354 - RNA, 23 nt, Artificial sequence
  specific aptamers
gguagguuuggaaugagguacau

SEQ ID NO: 2355 - RNA, 23 nt, Artificial sequence
  specific aptamers
gguagguuuggaaugagguaccu

SEQ ID NO: 2356 - RNA, 23 nt, Artificial sequence
  specific aptamers
gguagguuuggaaugagguacgu

SEQ ID NO: 2357 - RNA, 23 nt, Artificial sequence
  specific aptamers
gguagguuuggaaugagguacuu

SEQ ID NO: 2358 - RNA, 22 nt, Artificial sequence
  specific aptamers
gguagguuuggaaugagguacu

SEQ ID NO: 2359 - RNA, 23 nt, Artificial sequence
  specific aptamers
gguagguuuggaaugagguagau

SEQ ID NO: 2360 - RNA, 23 nt, Artificial sequence
  specific aptamers
gguagguuuggaaugagguagcu

SEQ ID NO: 2361 - RNA, 23 nt, Artificial sequence
  specific aptamers
gguagguuuggaaugagguaggu

SEQ ID NO: 2362 - RNA, 23 nt, Artificial sequence
  specific aptamers
gguagguuuggaaugagguaguu

SEQ ID NO: 2363 - RNA, 22 nt, Artificial sequence
  specific aptamers
gguagguuuggaaugagguagu

SEQ ID NO: 2364 - RNA, 23 nt, Artificial sequence
  specific aptamers
gguagguuuggaaugagguauau

SEQ ID NO: 2365 - RNA, 23 nt, Artificial sequence
  specific aptamers
gguagguuuggaaugagguaucu

SEQ ID NO: 2366 - RNA, 23 nt, Artificial sequence
  specific aptamers
gguagguuuggaaugagguaugu

SEQ ID NO: 2367 - RNA, 23 nt, Artificial sequence
  specific aptamers
gguagguuuggaaugagguauuu

SEQ ID NO: 2368 - RNA, 22 nt, Artificial sequence
  specific aptamers
gguagguuuggaaugagguauu

SEQ ID NO: 2369 - RNA, 23 nt, Artificial sequence
  specific aptamers
gguagguuuggcaugagguaaau

SEQ ID NO: 2370 - RNA, 23 nt, Artificial sequence
  specific aptamers
gguagguuuggcaugagguaacu

SEQ ID NO: 2371 - RNA, 23 nt, Artificial sequence
  specific aptamers
gguagguuuggcaugagguaagu

SEQ ID NO: 2372 - RNA, 23 nt, Artificial sequence
  specific aptamers
gguagguuuggcaugagguaauu

SEQ ID NO: 2373 - RNA, 22 nt, Artificial sequence
  specific aptamers
gguagguuuggcaugagguaau

SEQ ID NO: 2374 - RNA, 23 nt, Artificial sequence
  specific aptamers
gguagguuuggcaugagguacau

SEQ ID NO: 2375 - RNA, 23 nt, Artificial sequence
  specific aptamers
gguagguuuggcaugagguaccu

SEQ ID NO: 2376 - RNA, 23 nt, Artificial sequence
  specific aptamers
gguagguuuggcaugagguacgu

SEQ ID NO: 2377 - RNA, 23 nt, Artificial sequence
  specific aptamers
gguagguuuggcaugagguacuu

SEQ ID NO: 2378 - RNA, 22 nt, Artificial sequence
  specific aptamers
gguagguuuggcaugagguacu

SEQ ID NO: 2379 - RNA, 23 nt, Artificial sequence
  specific aptamers
gguagguuuggcaugagguagau

SEQ ID NO: 2380 - RNA, 23 nt, Artificial sequence
  specific aptamers
gguagguuuggcaugagguagcu

SEQ ID NO: 2381 - RNA, 23 nt, Artificial sequence
  specific aptamers
gguagguuuggcaugagguaggu

SEQ ID NO: 2382 - RNA, 23 nt, Artificial sequence
  specific aptamers
gguagguuuggcaugagguaguu

SEQ ID NO: 2383 - RNA, 22 nt, Artificial sequence
  specific aptamers
gguagguuuggcaugagguagu

SEQ ID NO: 2384 - RNA, 23 nt, Artificial sequence
  specific aptamers
gguagguuuggcaugagguauau

SEQ ID NO: 2385 - RNA, 23 nt, Artificial sequence
  specific aptamers
gguagguuuggcaugagguaucu

SEQ ID NO: 2386 - RNA, 23 nt, Artificial sequence
  specific aptamers
gguagguuuggcaugagguaugu

SEQ ID NO: 2387 - RNA, 23 nt, Artificial sequence
  specific aptamers
gguagguuuggcaugagguauuu

SEQ ID NO: 2388 - RNA, 22 nt, Artificial sequence
  specific aptamers
gguagguuuggcaugagguauu

SEQ ID NO: 2389 - RNA, 23 nt, Artificial sequence
  specific aptamers
gguagguuugguaugagguaaau

SEQ ID NO: 2390 - RNA, 23 nt, Artificial sequence
  specific aptamers
gguagguuugguaugagguaacu

SEQ ID NO: 2391 - RNA, 23 nt, Artificial sequence
  specific aptamers
gguagguuugguaugagguaagu

SEQ ID NO: 2392 - RNA, 23 nt, Artificial sequence
  specific aptamers
gguagguuugguaugagguaauu

SEQ ID NO: 2393 - RNA, 22 nt, Artificial sequence
  specific aptamers
gguagguuugguaugagguaau

SEQ ID NO: 2394 - RNA, 23 nt, Artificial sequence
  specific aptamers
gguagguuugguaugagguacau

SEQ ID NO: 2395 - RNA, 23 nt, Artificial sequence
  specific aptamers
gguagguuugguaugagguaccu

SEQ ID NO: 2396 - RNA, 23 nt, Artificial sequence
  specific aptamers
gguagguuugguaugagguacgu

SEQ ID NO: 2397 - RNA, 23 nt, Artificial sequence
  specific aptamers
gguagguuugguaugagguacuu

SEQ ID NO: 2398 - RNA, 22 nt, Artificial sequence
  specific aptamers
gguagguuugguaugagguacu

SEQ ID NO: 2399 - RNA, 23 nt, Artificial sequence
  specific aptamers
gguagguuugguaugagguagau

SEQ ID NO: 2400 - RNA, 23 nt, Artificial sequence
  specific aptamers
gguagguuugguaugagguagcu

SEQ ID NO: 2401 - RNA, 23 nt, Artificial sequence
  specific aptamers
gguagguuugguaugagguaggu

SEQ ID NO: 2402 - RNA, 23 nt, Artificial sequence
  specific aptamers
gguagguuugguaugagguaguu

SEQ ID NO: 2403 - RNA, 22 nt, Artificial sequence
  specific aptamers
gguagguuugguaugagguagu

SEQ ID NO: 2404 - RNA, 23 nt, Artificial sequence
  specific aptamers
gguagguuugguaugagguauau

SEQ ID NO: 2405 - RNA, 23 nt, Artificial sequence
  specific aptamers
gguagguuugguaugagguaucu

SEQ ID NO: 2406 - RNA, 23 nt, Artificial sequence
  specific aptamers
gguagguuugguaugagguaugu

SEQ ID NO: 2407 - RNA, 23 nt, Artificial sequence
  specific aptamers
gguagguuugguaugagguauuu

SEQ ID NO: 2408 - RNA, 22 nt, Artificial sequence
  specific aptamers
gguagguuugguaugagguauu

SEQ ID NO: 2409 - RNA, 21 nt, Artificial sequence
  specific aptamers
ggaagaggagaggaagaggag

SEQ ID NO: 2410 - RNA, 21 nt, Artificial sequence
  specific aptamers
ggaagaggagaggaagaggcg

SEQ ID NO: 2411 - RNA, 21 nt, Artificial sequence
  specific aptamers
ggaagaggagaggaagaggug

SEQ ID NO: 2412 - RNA, 21 nt, Artificial sequence
  specific aptamers
ggaagaggagaggaagcggag

SEQ ID NO: 2413 - RNA, 21 nt, Artificial sequence
  specific aptamers
ggaagaggagaggaagcggcg

SEQ ID NO: 2414 - RNA, 21 nt, Artificial sequence
  specific aptamers
ggaagaggagaggaagcggug

SEQ ID NO: 2415 - RNA, 21 nt, Artificial sequence
  specific aptamers
ggaagaggagaggaaguggag

SEQ ID NO: 2416 - RNA, 21 nt, Artificial sequence
  specific aptamers
ggaagaggagaggaaguggcg

SEQ ID NO: 2417 - RNA, 21 nt, Artificial sequence
  specific aptamers
ggaagaggagaggaaguggug

SEQ ID NO: 2418 - RNA, 21 nt, Artificial sequence
  specific aptamers
ggaagaggagaggaugaggag

SEQ ID NO: 2419 - RNA, 21 nt, Artificial sequence
  specific aptamers
ggaagaggagaggaugaggcg

SEQ ID NO: 2420 - RNA, 21 nt, Artificial sequence
  specific aptamers
ggaagaggagaggaugaggug

SEQ ID NO: 2421 - RNA, 21 nt, Artificial sequence
  specific aptamers
ggaagaggagaggaugcggag

SEQ ID NO: 2422 - RNA, 21 nt, Artificial sequence
  specific aptamers
ggaagaggagaggaugcggcg

SEQ ID NO: 2423 - RNA, 21 nt, Artificial sequence
  specific aptamers
ggaagaggagaggaugcggug

SEQ ID NO: 2424 - RNA, 21 nt, Artificial sequence
  specific aptamers
ggaagaggagaggauguggag

SEQ ID NO: 2425 - RNA, 21 nt, Artificial sequence
  specific aptamers
ggaagaggagaggauguggcg

SEQ ID NO: 2426 - RNA, 21 nt, Artificial sequence
  specific aptamers
ggaagaggagaggauguggug

SEQ ID NO: 2427 - RNA, 20 nt, Artificial sequence
  specific aptamers
ggaagaggagaggagaggag

SEQ ID NO: 2428 - RNA, 20 nt, Artificial sequence
  specific aptamers
ggaagaggagaggagaggcg

SEQ ID NO: 2429 - RNA, 20 nt, Artificial sequence
  specific aptamers
ggaagaggagaggagaggug

SEQ ID NO: 2430 - RNA, 20 nt, Artificial sequence
  specific aptamers
ggaagaggagaggagcggag

SEQ ID NO: 2431 - RNA, 20 nt, Artificial sequence
  specific aptamers
ggaagaggagaggagcggcg

SEQ ID NO: 2432 - RNA, 20 nt, Artificial sequence
  specific aptamers
ggaagaggagaggagcggug

SEQ ID NO: 2433 - RNA, 20 nt, Artificial sequence
  specific aptamers
ggaagaggagaggaguggag

SEQ ID NO: 2434 - RNA, 20 nt, Artificial sequence
  specific aptamers
ggaagaggagaggaguggcg

SEQ ID NO: 2435 - RNA, 20 nt, Artificial sequence
  specific aptamers
ggaagaggagaggaguggug

SEQ ID NO: 2436 - RNA, 21 nt, Artificial sequence
  specific aptamers
ggaagaggagagguagaggag

SEQ ID NO: 2437 - RNA, 21 nt, Artificial sequence
  specific aptamers
ggaagaggagagguagaggcg

SEQ ID NO: 2438 - RNA, 21 nt, Artificial sequence
  specific aptamers
ggaagaggagagguagaggug

SEQ ID NO: 2439 - RNA, 21 nt, Artificial sequence
  specific aptamers
ggaagaggagagguagcggag

SEQ ID NO: 2440 - RNA, 21 nt, Artificial sequence
  specific aptamers
ggaagaggagagguagcggcg

SEQ ID NO: 2441 - RNA, 21 nt, Artificial sequence
  specific aptamers
ggaagaggagagguagcggug

SEQ ID NO: 2442 - RNA, 21 nt, Artificial sequence
  specific aptamers
ggaagaggagagguaguggag

SEQ ID NO: 2443 - RNA, 21 nt, Artificial sequence
  specific aptamers
ggaagaggagagguaguggcg

SEQ ID NO: 2444 - RNA, 21 nt, Artificial sequence
  specific aptamers
ggaagaggagagguaguggug

SEQ ID NO: 2445 - RNA, 21 nt, Artificial sequence
  specific aptamers
ggaagaggagagguugaggag

SEQ ID NO: 2446 - RNA, 21 nt, Artificial sequence
  specific aptamers
ggaagaggagagguugaggcg

SEQ ID NO: 2447 - RNA, 21 nt, Artificial sequence
  specific aptamers
ggaagaggagagguugaggug

SEQ ID NO: 2448 - RNA, 21 nt, Artificial sequence
  specific aptamers
ggaagaggagagguugcggag

SEQ ID NO: 2449 - RNA, 21 nt, Artificial sequence
  specific aptamers
ggaagaggagagguugcggcg

SEQ ID NO: 2450 - RNA, 21 nt, Artificial sequence
  specific aptamers
ggaagaggagagguugcggug

SEQ ID NO: 2451 - RNA, 21 nt, Artificial sequence
  specific aptamers
ggaagaggagagguuguggag

SEQ ID NO: 2452 - RNA, 21 nt, Artificial sequence
  specific aptamers
ggaagaggagagguuguggcg

SEQ ID NO: 2453 - RNA, 21 nt, Artificial sequence
  specific aptamers
ggaagaggagagguuguggug

SEQ ID NO: 2454 - RNA, 20 nt, Artificial sequence
  specific aptamers
ggaagaggagaggugaggag

SEQ ID NO: 2455 - RNA, 20 nt, Artificial sequence
  specific aptamers
ggaagaggagaggugaggcg

SEQ ID NO: 2456 - RNA, 20 nt, Artificial sequence
  specific aptamers
ggaagaggagaggugaggug

SEQ ID NO: 2457 - RNA, 20 nt, Artificial sequence
  specific aptamers
ggaagaggagaggugcggag

SEQ ID NO: 2458 - RNA, 20 nt, Artificial sequence
  specific aptamers
ggaagaggagaggugcggcg

SEQ ID NO: 2459 - RNA, 20 nt, Artificial sequence
  specific aptamers
ggaagaggagaggugcggug

SEQ ID NO: 2460 - RNA, 20 nt, Artificial sequence
  specific aptamers
ggaagaggagagguguggag

SEQ ID NO: 2461 - RNA, 20 nt, Artificial sequence
  specific aptamers
ggaagaggagagguguggcg

SEQ ID NO: 2462 - RNA, 20 nt, Artificial sequence
  specific aptamers
ggaagaggagagguguggug

SEQ ID NO: 2463 - RNA, 21 nt, Artificial sequence
  specific aptamers
ggaagaggaguggaagaggag

SEQ ID NO: 2464 - RNA, 21 nt, Artificial sequence
  specific aptamers
ggaagaggaguggaagaggcg

SEQ ID NO: 2465 - RNA, 21 nt, Artificial sequence
  specific aptamers
ggaagaggaguggaagaggug

SEQ ID NO: 2466 - RNA, 21 nt, Artificial sequence
  specific aptamers
ggaagaggaguggaagcggag

SEQ ID NO: 2467 - RNA, 21 nt, Artificial sequence
  specific aptamers
ggaagaggaguggaagcggcg

SEQ ID NO: 2468 - RNA, 21 nt, Artificial sequence
  specific aptamers
ggaagaggaguggaagcggug

SEQ ID NO: 2469 - RNA, 21 nt, Artificial sequence
  specific aptamers
ggaagaggaguggaaguggag

SEQ ID NO: 2470 - RNA, 21 nt, Artificial sequence
  specific aptamers
ggaagaggaguggaaguggcg

SEQ ID NO: 2471 - RNA, 21 nt, Artificial sequence
  specific aptamers
ggaagaggaguggaaguggug

SEQ ID NO: 2472 - RNA, 21 nt, Artificial sequence
  specific aptamers
ggaagaggaguggaugaggag

SEQ ID NO: 2473 - RNA, 21 nt, Artificial sequence
  specific aptamers
ggaagaggaguggaugaggcg

SEQ ID NO: 2474 - RNA, 21 nt, Artificial sequence
  specific aptamers
ggaagaggaguggaugaggug

SEQ ID NO: 2475 - RNA, 21 nt, Artificial sequence
  specific aptamers
ggaagaggaguggaugcggag

SEQ ID NO: 2476 - RNA, 21 nt, Artificial sequence
  specific aptamers
ggaagaggaguggaugcggcg

SEQ ID NO: 2477 - RNA, 21 nt, Artificial sequence
  specific aptamers
ggaagaggaguggaugcggug

SEQ ID NO: 2478 - RNA, 21 nt, Artificial sequence
  specific aptamers
ggaagaggaguggauguggag

SEQ ID NO: 2479 - RNA, 21 nt, Artificial sequence
  specific aptamers
ggaagaggaguggauguggcg

SEQ ID NO: 2480 - RNA, 21 nt, Artificial sequence
  specific aptamers
ggaagaggaguggauguggug

SEQ ID NO: 2481 - RNA, 20 nt, Artificial sequence
  specific aptamers
ggaagaggaguggagaggag

SEQ ID NO: 2482 - RNA, 20 nt, Artificial sequence
  specific aptamers
ggaagaggaguggagaggcg

SEQ ID NO: 2483 - RNA, 20 nt, Artificial sequence
  specific aptamers
ggaagaggaguggagaggug

SEQ ID NO: 2484 - RNA, 20 nt, Artificial sequence
  specific aptamers
ggaagaggaguggagcggag

SEQ ID NO: 2485 - RNA, 20 nt, Artificial sequence
  specific aptamers
ggaagaggaguggagcggcg

SEQ ID NO: 2486 - RNA, 20 nt, Artificial sequence
  specific aptamers
ggaagaggaguggagcggug

SEQ ID NO: 2487 - RNA, 20 nt, Artificial sequence
  specific aptamers
ggaagaggaguggaguggag

SEQ ID NO: 2488 - RNA, 20 nt, Artificial sequence
  specific aptamers
ggaagaggaguggaguggcg

SEQ ID NO: 2489 - RNA, 20 nt, Artificial sequence
  specific aptamers
ggaagaggaguggaguggug

SEQ ID NO: 2490 - RNA, 21 nt, Artificial sequence
  specific aptamers
ggaagaggagugguagaggag

SEQ ID NO: 2491 - RNA, 21 nt, Artificial sequence
  specific aptamers
ggaagaggagugguagaggcg

SEQ ID NO: 2492 - RNA, 21 nt, Artificial sequence
  specific aptamers
ggaagaggagugguagaggug

SEQ ID NO: 2493 - RNA, 21 nt, Artificial sequence
  specific aptamers
ggaagaggagugguagcggag

SEQ ID NO: 2494 - RNA, 21 nt, Artificial sequence
  specific aptamers
ggaagaggagugguagcggcg

SEQ ID NO: 2495 - RNA, 21 nt, Artificial sequence
  specific aptamers
ggaagaggagugguagcggug

SEQ ID NO: 2496 - RNA, 21 nt, Artificial sequence
  specific aptamers
ggaagaggagugguaguggag

SEQ ID NO: 2497 - RNA, 21 nt, Artificial sequence
  specific aptamers
ggaagaggagugguaguggcg

SEQ ID NO: 2498 - RNA, 21 nt, Artificial sequence
  specific aptamers
ggaagaggagugguaguggug

SEQ ID NO: 2499 - RNA, 21 nt, Artificial sequence
  specific aptamers
ggaagaggagugguugaggag

SEQ ID NO: 2500 - RNA, 21 nt, Artificial sequence
  specific aptamers
ggaagaggagugguugaggcg

SEQ ID NO: 2501 - RNA, 21 nt, Artificial sequence
  specific aptamers
ggaagaggagugguugaggug

SEQ ID NO: 2502 - RNA, 21 nt, Artificial sequence
  specific aptamers
ggaagaggagugguugcggag

SEQ ID NO: 2503 - RNA, 21 nt, Artificial sequence
  specific aptamers
ggaagaggagugguugcggcg

SEQ ID NO: 2504 - RNA, 21 nt, Artificial sequence
  specific aptamers
ggaagaggagugguugcggug

SEQ ID NO: 2505 - RNA, 21 nt, Artificial sequence
  specific aptamers
ggaagaggagugguuguggag

SEQ ID NO: 2506 - RNA, 21 nt, Artificial sequence
  specific aptamers
ggaagaggagugguuguggcg

SEQ ID NO: 2507 - RNA, 21 nt, Artificial sequence
  specific aptamers
ggaagaggagugguuguggug

SEQ ID NO: 2508 - RNA, 20 nt, Artificial sequence
  specific aptamers
ggaagaggaguggugaggag

SEQ ID NO: 2509 - RNA, 20 nt, Artificial sequence
  specific aptamers
ggaagaggaguggugaggcg

SEQ ID NO: 2510 - RNA, 20 nt, Artificial sequence
  specific aptamers
ggaagaggaguggugaggug

SEQ ID NO: 2511 - RNA, 20 nt, Artificial sequence
  specific aptamers
ggaagaggaguggugcggag

SEQ ID NO: 2512 - RNA, 20 nt, Artificial sequence
  specific aptamers
ggaagaggaguggugcggcg

SEQ ID NO: 2513 - RNA, 20 nt, Artificial sequence
  specific aptamers
ggaagaggaguggugcggug

SEQ ID NO: 2514 - RNA, 20 nt, Artificial sequence
  specific aptamers
ggaagaggagugguguggag

SEQ ID NO: 2515 - RNA, 20 nt, Artificial sequence
  specific aptamers
ggaagaggagugguguggcg

SEQ ID NO: 2516 - RNA, 20 nt, Artificial sequence
  specific aptamers
ggaagaggagugguguggug

SEQ ID NO: 2517 - RNA, 21 nt, Artificial sequence
  specific aptamers
ggaagaggugaggaagaggag

SEQ ID NO: 2518 - RNA, 21 nt, Artificial sequence
  specific aptamers
ggaagaggugaggaagaggcg

SEQ ID NO: 2519 - RNA, 21 nt, Artificial sequence
  specific aptamers
ggaagaggugaggaagaggug

SEQ ID NO: 2520 - RNA, 21 nt, Artificial sequence
  specific aptamers
ggaagaggugaggaagcggag

SEQ ID NO: 2521 - RNA, 21 nt, Artificial sequence
  specific aptamers
ggaagaggugaggaagcggcg

SEQ ID NO: 2522 - RNA, 21 nt, Artificial sequence
  specific aptamers
ggaagaggugaggaagcggug

SEQ ID NO: 2523 - RNA, 21 nt, Artificial sequence
  specific aptamers
ggaagaggugaggaaguggag

SEQ ID NO: 2524 - RNA, 21 nt, Artificial sequence
  specific aptamers
ggaagaggugaggaaguggcg

SEQ ID NO: 2525 - RNA, 21 nt, Artificial sequence
  specific aptamers
ggaagaggugaggaaguggug

SEQ ID NO: 2526 - RNA, 21 nt, Artificial sequence
  specific aptamers
ggaagaggugaggaugaggag

SEQ ID NO: 2527 - RNA, 21 nt, Artificial sequence
  specific aptamers
ggaagaggugaggaugaggcg

SEQ ID NO: 2528 - RNA, 21 nt, Artificial sequence
  specific aptamers
ggaagaggugaggaugaggug

SEQ ID NO: 2529 - RNA, 21 nt, Artificial sequence
  specific aptamers
ggaagaggugaggaugcggag

SEQ ID NO: 2530 - RNA, 21 nt, Artificial sequence
  specific aptamers
ggaagaggugaggaugcggcg

SEQ ID NO: 2531 - RNA, 21 nt, Artificial sequence
  specific aptamers
ggaagaggugaggaugcggug

SEQ ID NO: 2532 - RNA, 21 nt, Artificial sequence
  specific aptamers
ggaagaggugaggauguggag

SEQ ID NO: 2533 - RNA, 21 nt, Artificial sequence
  specific aptamers
ggaagaggugaggauguggcg

SEQ ID NO: 2534 - RNA, 21 nt, Artificial sequence
  specific aptamers
ggaagaggugaggauguggug

SEQ ID NO: 2535 - RNA, 20 nt, Artificial sequence
  specific aptamers
ggaagaggugaggagaggag

SEQ ID NO: 2536 - RNA, 20 nt, Artificial sequence
  specific aptamers
ggaagaggugaggagaggcg

SEQ ID NO: 2537 - RNA, 20 nt, Artificial sequence
  specific aptamers
ggaagaggugaggagaggug

SEQ ID NO: 2538 - RNA, 20 nt, Artificial sequence
  specific aptamers
ggaagaggugaggagcggag

SEQ ID NO: 2539 - RNA, 20 nt, Artificial sequence
  specific aptamers
ggaagaggugaggagcggcg

SEQ ID NO: 2540 - RNA, 20 nt, Artificial sequence
  specific aptamers
ggaagaggugaggagcggug

SEQ ID NO: 2541 - RNA, 20 nt, Artificial sequence
  specific aptamers
ggaagaggugaggaguggag

SEQ ID NO: 2542 - RNA, 20 nt, Artificial sequence
  specific aptamers
ggaagaggugaggaguggcg

SEQ ID NO: 2543 - RNA, 20 nt, Artificial sequence
  specific aptamers
ggaagaggugaggaguggug

SEQ ID NO: 2544 - RNA, 21 nt, Artificial sequence
  specific aptamers
ggaagaggugagguagaggag

SEQ ID NO: 2545 - RNA, 21 nt, Artificial sequence
  specific aptamers
ggaagaggugagguagaggcg

SEQ ID NO: 2546 - RNA, 21 nt, Artificial sequence
  specific aptamers
ggaagaggugagguagaggug

SEQ ID NO: 2547 - RNA, 21 nt, Artificial sequence
  specific aptamers
ggaagaggugagguagcggag

SEQ ID NO: 2548 - RNA, 21 nt, Artificial sequence
  specific aptamers
ggaagaggugagguagcggcg

SEQ ID NO: 2549 - RNA, 21 nt, Artificial sequence
  specific aptamers
ggaagaggugagguagcggug

SEQ ID NO: 2550 - RNA, 21 nt, Artificial sequence
  specific aptamers
ggaagaggugagguaguggag

SEQ ID NO: 2551 - RNA, 21 nt, Artificial sequence
  specific aptamers
ggaagaggugagguaguggcg

SEQ ID NO: 2552 - RNA, 21 nt, Artificial sequence
  specific aptamers
ggaagaggugagguaguggug

SEQ ID NO: 2553 - RNA, 21 nt, Artificial sequence
  specific aptamers
ggaagaggugagguugaggag

SEQ ID NO: 2554 - RNA, 21 nt, Artificial sequence
  specific aptamers
ggaagaggugagguugaggcg

SEQ ID NO: 2555 - RNA, 21 nt, Artificial sequence
  specific aptamers
ggaagaggugagguugaggug

SEQ ID NO: 2556 - RNA, 21 nt, Artificial sequence
  specific aptamers
ggaagaggugagguugcggag

SEQ ID NO: 2557 - RNA, 21 nt, Artificial sequence
  specific aptamers
ggaagaggugagguugcggcg

SEQ ID NO: 2558 - RNA, 21 nt, Artificial sequence
  specific aptamers
ggaagaggugagguugcggug

SEQ ID NO: 2559 - RNA, 21 nt, Artificial sequence
  specific aptamers
ggaagaggugagguuguggag

SEQ ID NO: 2560 - RNA, 21 nt, Artificial sequence
  specific aptamers
ggaagaggugagguuguggcg

SEQ ID NO: 2561 - RNA, 21 nt, Artificial sequence
  specific aptamers
ggaagaggugagguuguggug

SEQ ID NO: 2562 - RNA, 20 nt, Artificial sequence
  specific aptamers
ggaagaggugaggugaggag

SEQ ID NO: 2563 - RNA, 20 nt, Artificial sequence
  specific aptamers
ggaagaggugaggugaggcg

SEQ ID NO: 2564 - RNA, 20 nt, Artificial sequence
  specific aptamers
ggaagaggugaggugaggug

SEQ ID NO: 2565 - RNA, 20 nt, Artificial sequence
  specific aptamers
ggaagaggugaggugcggag

SEQ ID NO: 2566 - RNA, 20 nt, Artificial sequence
  specific aptamers
ggaagaggugaggugcggcg

SEQ ID NO: 2567 - RNA, 20 nt, Artificial sequence
  specific aptamers
ggaagaggugaggugcggug

SEQ ID NO: 2568 - RNA, 20 nt, Artificial sequence
  specific aptamers
ggaagaggugagguguggag

SEQ ID NO: 2569 - RNA, 20 nt, Artificial sequence
  specific aptamers
ggaagaggugagguguggcg

SEQ ID NO: 2570 - RNA, 20 nt, Artificial sequence
  specific aptamers
ggaagaggugagguguggug

SEQ ID NO: 2571 - RNA, 21 nt, Artificial sequence
  specific aptamers
ggaagagguguggaagaggag

SEQ ID NO: 2572 - RNA, 21 nt, Artificial sequence
  specific aptamers
ggaagagguguggaagaggcg

SEQ ID NO: 2573 - RNA, 21 nt, Artificial sequence
  specific aptamers
ggaagagguguggaagaggug

SEQ ID NO: 2574 - RNA, 21 nt, Artificial sequence
  specific aptamers
ggaagagguguggaagcggag

SEQ ID NO: 2575 - RNA, 21 nt, Artificial sequence
  specific aptamers
ggaagagguguggaagcggcg

SEQ ID NO: 2576 - RNA, 21 nt, Artificial sequence
  specific aptamers
ggaagagguguggaagcggug

SEQ ID NO: 2577 - RNA, 21 nt, Artificial sequence
  specific aptamers
ggaagagguguggaaguggag

SEQ ID NO: 2578 - RNA, 21 nt, Artificial sequence
  specific aptamers
ggaagagguguggaaguggcg

SEQ ID NO: 2579 - RNA, 21 nt, Artificial sequence
  specific aptamers
ggaagagguguggaaguggug

SEQ ID NO: 2580 - RNA, 21 nt, Artificial sequence
  specific aptamers
ggaagagguguggaugaggag

SEQ ID NO: 2581 - RNA, 21 nt, Artificial sequence
  specific aptamers
ggaagagguguggaugaggcg

SEQ ID NO: 2582 - RNA, 21 nt, Artificial sequence
  specific aptamers
ggaagagguguggaugaggug

SEQ ID NO: 2583 - RNA, 21 nt, Artificial sequence
  specific aptamers
ggaagagguguggaugcggag

SEQ ID NO: 2584 - RNA, 21 nt, Artificial sequence
  specific aptamers
ggaagagguguggaugcggcg

SEQ ID NO: 2585 - RNA, 21 nt, Artificial sequence
  specific aptamers
ggaagagguguggaugcggug

SEQ ID NO: 2586 - RNA, 21 nt, Artificial sequence
  specific aptamers
ggaagagguguggauguggag

SEQ ID NO: 2587 - RNA, 21 nt, Artificial sequence
  specific aptamers
ggaagagguguggauguggcg

SEQ ID NO: 2588 - RNA, 21 nt, Artificial sequence
  specific aptamers
ggaagagguguggauguggug

SEQ ID NO: 2589 - RNA, 20 nt, Artificial sequence
  specific aptamers
ggaagagguguggagaggag

SEQ ID NO: 2590 - RNA, 20 nt, Artificial sequence
  specific aptamers
ggaagagguguggagaggcg

SEQ ID NO: 2591 - RNA, 20 nt, Artificial sequence
  specific aptamers
ggaagagguguggagaggug

SEQ ID NO: 2592 - RNA, 20 nt, Artificial sequence
  specific aptamers
ggaagagguguggagcggag

SEQ ID NO: 2593 - RNA, 20 nt, Artificial sequence
  specific aptamers
ggaagagguguggagcggcg

SEQ ID NO: 2594 - RNA, 20 nt, Artificial sequence
  specific aptamers
ggaagagguguggagcggug

SEQ ID NO: 2595 - RNA, 20 nt, Artificial sequence
  specific aptamers
ggaagagguguggaguggag

SEQ ID NO: 2596 - RNA, 20 nt, Artificial sequence
  specific aptamers
ggaagagguguggaguggcg

SEQ ID NO: 2597 - RNA, 20 nt, Artificial sequence
  specific aptamers
ggaagagguguggaguggug

SEQ ID NO: 2598 - RNA, 21 nt, Artificial sequence
  specific aptamers
ggaagaggugugguagaggag

SEQ ID NO: 2599 - RNA, 21 nt, Artificial sequence
  specific aptamers
ggaagaggugugguagaggcg

SEQ ID NO: 2600 - RNA, 21 nt, Artificial sequence
  specific aptamers
ggaagaggugugguagaggug

SEQ ID NO: 2601 - RNA, 21 nt, Artificial sequence
  specific aptamers
ggaagaggugugguagcggag

SEQ ID NO: 2602 - RNA, 21 nt, Artificial sequence
  specific aptamers
ggaagaggugugguagcggcg

SEQ ID NO: 2603 - RNA, 21 nt, Artificial sequence
  specific aptamers
ggaagaggugugguagcggug

SEQ ID NO: 2604 - RNA, 21 nt, Artificial sequence
  specific aptamers
ggaagaggugugguaguggag

SEQ ID NO: 2605 - RNA, 21 nt, Artificial sequence
  specific aptamers
ggaagaggugugguaguggcg

SEQ ID NO: 2606 - RNA, 21 nt, Artificial sequence
  specific aptamers
ggaagaggugugguaguggug

SEQ ID NO: 2607 - RNA, 21 nt, Artificial sequence
  specific aptamers
ggaagaggugugguugaggag

SEQ ID NO: 2608 - RNA, 21 nt, Artificial sequence
  specific aptamers
ggaagaggugugguugaggcg

SEQ ID NO: 2609 - RNA, 21 nt, Artificial sequence
  specific aptamers
ggaagaggugugguugaggug

SEQ ID NO: 2610 - RNA, 21 nt, Artificial sequence
  specific aptamers
ggaagaggugugguugcggag

SEQ ID NO: 2611 - RNA, 21 nt, Artificial sequence
  specific aptamers
ggaagaggugugguugcggcg

SEQ ID NO: 2612 - RNA, 21 nt, Artificial sequence
  specific aptamers
ggaagaggugugguugcggug

SEQ ID NO: 2613 - RNA, 21 nt, Artificial sequence
  specific aptamers
ggaagaggugugguuguggag

SEQ ID NO: 2614 - RNA, 21 nt, Artificial sequence
  specific aptamers
ggaagaggugugguuguggcg

SEQ ID NO: 2615 - RNA, 21 nt, Artificial sequence
  specific aptamers
ggaagaggugugguuguggug

SEQ ID NO: 2616 - RNA, 20 nt, Artificial sequence
  specific aptamers
ggaagagguguggugaggag

SEQ ID NO: 2617 - RNA, 20 nt, Artificial sequence
  specific aptamers
ggaagagguguggugaggcg

SEQ ID NO: 2618 - RNA, 20 nt, Artificial sequence
  specific aptamers
ggaagagguguggugaggug

SEQ ID NO: 2619 - RNA, 20 nt, Artificial sequence
  specific aptamers
ggaagagguguggugcggag

SEQ ID NO: 2620 - RNA, 20 nt, Artificial sequence
  specific aptamers
ggaagagguguggugcggcg

SEQ ID NO: 2621 - RNA, 20 nt, Artificial sequence
  specific aptamers
ggaagagguguggugcggug

SEQ ID NO: 2622 - RNA, 20 nt, Artificial sequence
  specific aptamers
ggaagaggugugguguggag

SEQ ID NO: 2623 - RNA, 20 nt, Artificial sequence
  specific aptamers
ggaagaggugugguguggcg

SEQ ID NO: 2624 - RNA, 20 nt, Artificial sequence
  specific aptamers
ggaagaggugugguguggug

SEQ ID NO: 2625 - RNA, 21 nt, Artificial sequence
  specific aptamers
ggaaguggagaggaagaggag

SEQ ID NO: 2626 - RNA, 21 nt, Artificial sequence
  specific aptamers
ggaaguggagaggaagaggcg

SEQ ID NO: 2627 - RNA, 21 nt, Artificial sequence
  specific aptamers
ggaaguggagaggaagaggug

SEQ ID NO: 2628 - RNA, 21 nt, Artificial sequence
  specific aptamers
ggaaguggagaggaagcggag

SEQ ID NO: 2629 - RNA, 21 nt, Artificial sequence
  specific aptamers
ggaaguggagaggaagcggcg

SEQ ID NO: 2630 - RNA, 21 nt, Artificial sequence
  specific aptamers
ggaaguggagaggaagcggug

SEQ ID NO: 2631 - RNA, 21 nt, Artificial sequence
  specific aptamers
ggaaguggagaggaaguggag

SEQ ID NO: 2632 - RNA, 21 nt, Artificial sequence
  specific aptamers
ggaaguggagaggaaguggcg

SEQ ID NO: 2633 - RNA, 21 nt, Artificial sequence
  specific aptamers
ggaaguggagaggaaguggug

SEQ ID NO: 2634 - RNA, 21 nt, Artificial sequence
  specific aptamers
ggaaguggagaggaugaggag

SEQ ID NO: 2635 - RNA, 21 nt, Artificial sequence
  specific aptamers
ggaaguggagaggaugaggcg

SEQ ID NO: 2636 - RNA, 21 nt, Artificial sequence
  specific aptamers
ggaaguggagaggaugaggug

SEQ ID NO: 2637 - RNA, 21 nt, Artificial sequence
  specific aptamers
ggaaguggagaggaugcggag

SEQ ID NO: 2638 - RNA, 21 nt, Artificial sequence
  specific aptamers
ggaaguggagaggaugcggcg

SEQ ID NO: 2639 - RNA, 21 nt, Artificial sequence
  specific aptamers
ggaaguggagaggaugcggug

SEQ ID NO: 2640 - RNA, 21 nt, Artificial sequence
  specific aptamers
ggaaguggagaggauguggag

SEQ ID NO: 2641 - RNA, 21 nt, Artificial sequence
  specific aptamers
ggaaguggagaggauguggcg

SEQ ID NO: 2642 - RNA, 21 nt, Artificial sequence
  specific aptamers
ggaaguggagaggauguggug

SEQ ID NO: 2643 - RNA, 20 nt, Artificial sequence
  specific aptamers
ggaaguggagaggagaggag

SEQ ID NO: 2644 - RNA, 20 nt, Artificial sequence
  specific aptamers
ggaaguggagaggagaggcg

SEQ ID NO: 2645 - RNA, 20 nt, Artificial sequence
  specific aptamers
ggaaguggagaggagaggug

SEQ ID NO: 2646 - RNA, 20 nt, Artificial sequence
  specific aptamers
ggaaguggagaggagcggag

SEQ ID NO: 2647 - RNA, 20 nt, Artificial sequence
  specific aptamers
ggaaguggagaggagcggcg

SEQ ID NO: 2648 - RNA, 20 nt, Artificial sequence
  specific aptamers
ggaaguggagaggagcggug

SEQ ID NO: 2649 - RNA, 20 nt, Artificial sequence
  specific aptamers
ggaaguggagaggaguggag

SEQ ID NO: 2650 - RNA, 20 nt, Artificial sequence
  specific aptamers
ggaaguggagaggaguggcg

SEQ ID NO: 2651 - RNA, 20 nt, Artificial sequence
  specific aptamers
ggaaguggagaggaguggug

SEQ ID NO: 2652 - RNA, 21 nt, Artificial sequence
  specific aptamers
ggaaguggagagguagaggag

SEQ ID NO: 2653 - RNA, 21 nt, Artificial sequence
  specific aptamers
ggaaguggagagguagaggcg

SEQ ID NO: 2654 - RNA, 21 nt, Artificial sequence
  specific aptamers
ggaaguggagagguagaggug

SEQ ID NO: 2655 - RNA, 21 nt, Artificial sequence
  specific aptamers
ggaaguggagagguagcggag

SEQ ID NO: 2656 - RNA, 21 nt, Artificial sequence
  specific aptamers
ggaaguggagagguagcggcg

SEQ ID NO: 2657 - RNA, 21 nt, Artificial sequence
  specific aptamers
ggaaguggagagguagcggug

SEQ ID NO: 2658 - RNA, 21 nt, Artificial sequence
  specific aptamers
ggaaguggagagguaguggag

SEQ ID NO: 2659 - RNA, 21 nt, Artificial sequence
  specific aptamers
ggaaguggagagguaguggcg

SEQ ID NO: 2660 - RNA, 21 nt, Artificial sequence
  specific aptamers
ggaaguggagagguaguggug

SEQ ID NO: 2661 - RNA, 21 nt, Artificial sequence
  specific aptamers
ggaaguggagagguugaggag

SEQ ID NO: 2662 - RNA, 21 nt, Artificial sequence
  specific aptamers
ggaaguggagagguugaggcg

SEQ ID NO: 2663 - RNA, 21 nt, Artificial sequence
  specific aptamers
ggaaguggagagguugaggug

SEQ ID NO: 2664 - RNA, 21 nt, Artificial sequence
  specific aptamers
ggaaguggagagguugcggag

SEQ ID NO: 2665 - RNA, 21 nt, Artificial sequence
  specific aptamers
ggaaguggagagguugcggcg

SEQ ID NO: 2666 - RNA, 21 nt, Artificial sequence
  specific aptamers
ggaaguggagagguugcggug

SEQ ID NO: 2667 - RNA, 21 nt, Artificial sequence
  specific aptamers
ggaaguggagagguuguggag

SEQ ID NO: 2668 - RNA, 21 nt, Artificial sequence
  specific aptamers
ggaaguggagagguuguggcg

SEQ ID NO: 2669 - RNA, 21 nt, Artificial sequence
  specific aptamers
ggaaguggagagguuguggug

SEQ ID NO: 2670 - RNA, 20 nt, Artificial sequence
  specific aptamers
ggaaguggagaggugaggag

SEQ ID NO: 2671 - RNA, 20 nt, Artificial sequence
  specific aptamers
ggaaguggagaggugaggcg

SEQ ID NO: 2672 - RNA, 20 nt, Artificial sequence
  specific aptamers
ggaaguggagaggugaggug

SEQ ID NO: 2673 - RNA, 20 nt, Artificial sequence
  specific aptamers
ggaaguggagaggugcggag

SEQ ID NO: 2674 - RNA, 20 nt, Artificial sequence
  specific aptamers
ggaaguggagaggugcggcg

SEQ ID NO: 2675 - RNA, 20 nt, Artificial sequence
  specific aptamers
ggaaguggagaggugcggug

SEQ ID NO: 2676 - RNA, 20 nt, Artificial sequence
  specific aptamers
ggaaguggagagguguggag

SEQ ID NO: 2677 - RNA, 20 nt, Artificial sequence
  specific aptamers
ggaaguggagagguguggcg

SEQ ID NO: 2678 - RNA, 20 nt, Artificial sequence
  specific aptamers
ggaaguggagagguguggug

SEQ ID NO: 2679 - RNA, 21 nt, Artificial sequence
  specific aptamers
ggaaguggaguggaagaggag

SEQ ID NO: 2680 - RNA, 21 nt, Artificial sequence
  specific aptamers
ggaaguggaguggaagaggcg

SEQ ID NO: 2681 - RNA, 21 nt, Artificial sequence
  specific aptamers
ggaaguggaguggaagaggug

SEQ ID NO: 2682 - RNA, 21 nt, Artificial sequence
  specific aptamers
ggaaguggaguggaagcggag

SEQ ID NO: 2683 - RNA, 21 nt, Artificial sequence
  specific aptamers
ggaaguggaguggaagcggcg

SEQ ID NO: 2684 - RNA, 21 nt, Artificial sequence
  specific aptamers
ggaaguggaguggaagcggug

SEQ ID NO: 2685 - RNA, 21 nt, Artificial sequence
  specific aptamers
ggaaguggaguggaaguggag

SEQ ID NO: 2686 - RNA, 21 nt, Artificial sequence
  specific aptamers
ggaaguggaguggaaguggcg

SEQ ID NO: 2687 - RNA, 21 nt, Artificial sequence
  specific aptamers
ggaaguggaguggaaguggug

SEQ ID NO: 2688 - RNA, 21 nt, Artificial sequence
  specific aptamers
ggaaguggaguggaugaggag

SEQ ID NO: 2689 - RNA, 21 nt, Artificial sequence
  specific aptamers
ggaaguggaguggaugaggcg

SEQ ID NO: 2690 - RNA, 21 nt, Artificial sequence
  specific aptamers
ggaaguggaguggaugaggug

SEQ ID NO: 2691 - RNA, 21 nt, Artificial sequence
  specific aptamers
ggaaguggaguggaugcggag

SEQ ID NO: 2692 - RNA, 21 nt, Artificial sequence
  specific aptamers
ggaaguggaguggaugcggcg

SEQ ID NO: 2693 - RNA, 21 nt, Artificial sequence
  specific aptamers
ggaaguggaguggaugcggug

SEQ ID NO: 2694 - RNA, 21 nt, Artificial sequence
  specific aptamers
ggaaguggaguggauguggag

SEQ ID NO: 2695 - RNA, 21 nt, Artificial sequence
  specific aptamers
ggaaguggaguggauguggcg

SEQ ID NO: 2696 - RNA, 21 nt, Artificial sequence
  specific aptamers
ggaaguggaguggauguggug

SEQ ID NO: 2697 - RNA, 20 nt, Artificial sequence
  specific aptamers
ggaaguggaguggagaggag

SEQ ID NO: 2698 - RNA, 20 nt, Artificial sequence
  specific aptamers
ggaaguggaguggagaggcg

SEQ ID NO: 2699 - RNA, 20 nt, Artificial sequence
  specific aptamers
ggaaguggaguggagaggug

SEQ ID NO: 2700 - RNA, 20 nt, Artificial sequence
  specific aptamers
ggaaguggaguggagcggag

SEQ ID NO: 2701 - RNA, 20 nt, Artificial sequence
  specific aptamers
ggaaguggaguggagcggcg

SEQ ID NO: 2702 - RNA, 20 nt, Artificial sequence
  specific aptamers
ggaaguggaguggagcggug

SEQ ID NO: 2703 - RNA, 20 nt, Artificial sequence
  specific aptamers
ggaaguggaguggaguggag

SEQ ID NO: 2704 - RNA, 20 nt, Artificial sequence
  specific aptamers
ggaaguggaguggaguggcg

SEQ ID NO: 2705 - RNA, 20 nt, Artificial sequence
  specific aptamers
ggaaguggaguggaguggug

SEQ ID NO: 2706 - RNA, 21 nt, Artificial sequence
  specific aptamers
ggaaguggagugguagaggag

SEQ ID NO: 2707 - RNA, 21 nt, Artificial sequence
  specific aptamers
ggaaguggagugguagaggcg

SEQ ID NO: 2708 - RNA, 21 nt, Artificial sequence
  specific aptamers
ggaaguggagugguagaggug

SEQ ID NO: 2709 - RNA, 21 nt, Artificial sequence
  specific aptamers
ggaaguggagugguagcggag

SEQ ID NO: 2710 - RNA, 21 nt, Artificial sequence
  specific aptamers
ggaaguggagugguagcggcg

SEQ ID NO: 2711 - RNA, 21 nt, Artificial sequence
  specific aptamers
ggaaguggagugguagcggug

SEQ ID NO: 2712 - RNA, 21 nt, Artificial sequence
  specific aptamers
ggaaguggagugguaguggag

SEQ ID NO: 2713 - RNA, 21 nt, Artificial sequence
  specific aptamers
ggaaguggagugguaguggcg

SEQ ID NO: 2714 - RNA, 21 nt, Artificial sequence
  specific aptamers
ggaaguggagugguaguggug

SEQ ID NO: 2715 - RNA, 21 nt, Artificial sequence
  specific aptamers
ggaaguggagugguugaggag

SEQ ID NO: 2716 - RNA, 21 nt, Artificial sequence
  specific aptamers
ggaaguggagugguugaggcg

SEQ ID NO: 2717 - RNA, 21 nt, Artificial sequence
  specific aptamers
ggaaguggagugguugaggug

SEQ ID NO: 2718 - RNA, 21 nt, Artificial sequence
  specific aptamers
ggaaguggagugguugcggag

SEQ ID NO: 2719 - RNA, 21 nt, Artificial sequence
  specific aptamers
ggaaguggagugguugcggcg

SEQ ID NO: 2720 - RNA, 21 nt, Artificial sequence
  specific aptamers
ggaaguggagugguugcggug

SEQ ID NO: 2721 - RNA, 21 nt, Artificial sequence
  specific aptamers
ggaaguggagugguuguggag

SEQ ID NO: 2722 - RNA, 21 nt, Artificial sequence
  specific aptamers
ggaaguggagugguuguggcg

SEQ ID NO: 2723 - RNA, 21 nt, Artificial sequence
  specific aptamers
ggaaguggagugguuguggug

SEQ ID NO: 2724 - RNA, 20 nt, Artificial sequence
  specific aptamers
ggaaguggaguggugaggag

SEQ ID NO: 2725 - RNA, 20 nt, Artificial sequence
  specific aptamers
ggaaguggaguggugaggcg

SEQ ID NO: 2726 - RNA, 20 nt, Artificial sequence
  specific aptamers
ggaaguggaguggugaggug

SEQ ID NO: 2727 - RNA, 20 nt, Artificial sequence
  specific aptamers
ggaaguggaguggugcggag

SEQ ID NO: 2728 - RNA, 20 nt, Artificial sequence
  specific aptamers
ggaaguggaguggugcggcg

SEQ ID NO: 2729 - RNA, 20 nt, Artificial sequence
  specific aptamers
ggaaguggaguggugcggug

SEQ ID NO: 2730 - RNA, 20 nt, Artificial sequence
  specific aptamers
ggaaguggagugguguggag

SEQ ID NO: 2731 - RNA, 20 nt, Artificial sequence
  specific aptamers
ggaaguggagugguguggcg

SEQ ID NO: 2732 - RNA, 20 nt, Artificial sequence
  specific aptamers
ggaaguggagugguguggug

SEQ ID NO: 2733 - RNA, 21 nt, Artificial sequence
  specific aptamers
ggaaguggugaggaagaggag

SEQ ID NO: 2734 - RNA, 21 nt, Artificial sequence
  specific aptamers
ggaaguggugaggaagaggcg

SEQ ID NO: 2735 - RNA, 21 nt, Artificial sequence
  specific aptamers
ggaaguggugaggaagaggug

SEQ ID NO: 2736 - RNA, 21 nt, Artificial sequence
  specific aptamers
ggaaguggugaggaagcggag

SEQ ID NO: 2737 - RNA, 21 nt, Artificial sequence
  specific aptamers
ggaaguggugaggaagcggcg

SEQ ID NO: 2738 - RNA, 21 nt, Artificial sequence
  specific aptamers
ggaaguggugaggaagcggug

SEQ ID NO: 2739 - RNA, 21 nt, Artificial sequence
  specific aptamers
ggaaguggugaggaaguggag

SEQ ID NO: 2740 - RNA, 21 nt, Artificial sequence
  specific aptamers
ggaaguggugaggaaguggcg

SEQ ID NO: 2741 - RNA, 21 nt, Artificial sequence
  specific aptamers
ggaaguggugaggaaguggug

SEQ ID NO: 2742 - RNA, 21 nt, Artificial sequence
  specific aptamers
ggaaguggugaggaugaggag

SEQ ID NO: 2743 - RNA, 21 nt, Artificial sequence
  specific aptamers
ggaaguggugaggaugaggcg

SEQ ID NO: 2744 - RNA, 21 nt, Artificial sequence
  specific aptamers
ggaaguggugaggaugaggug

SEQ ID NO: 2745 - RNA, 21 nt, Artificial sequence
  specific aptamers
ggaaguggugaggaugcggag

SEQ ID NO: 2746 - RNA, 21 nt, Artificial sequence
  specific aptamers
ggaaguggugaggaugcggcg

SEQ ID NO: 2747 - RNA, 21 nt, Artificial sequence
  specific aptamers
ggaaguggugaggaugcggug

SEQ ID NO: 2748 - RNA, 21 nt, Artificial sequence
  specific aptamers
ggaaguggugaggauguggag

SEQ ID NO: 2749 - RNA, 21 nt, Artificial sequence
  specific aptamers
ggaaguggugaggauguggcg

SEQ ID NO: 2750 - RNA, 21 nt, Artificial sequence
  specific aptamers
ggaaguggugaggauguggug

SEQ ID NO: 2751 - RNA, 20 nt, Artificial sequence
  specific aptamers
ggaaguggugaggagaggag

SEQ ID NO: 2752 - RNA, 20 nt, Artificial sequence
  specific aptamers
ggaaguggugaggagaggcg

SEQ ID NO: 2753 - RNA, 20 nt, Artificial sequence
  specific aptamers
ggaaguggugaggagaggug

SEQ ID NO: 2754 - RNA, 20 nt, Artificial sequence
  specific aptamers
ggaaguggugaggagcggag

SEQ ID NO: 2755 - RNA, 20 nt, Artificial sequence
  specific aptamers
ggaaguggugaggagcggcg

SEQ ID NO: 2756 - RNA, 20 nt, Artificial sequence
  specific aptamers
ggaaguggugaggagcggug

SEQ ID NO: 2757 - RNA, 20 nt, Artificial sequence
  specific aptamers
ggaaguggugaggaguggag

SEQ ID NO: 2758 - RNA, 20 nt, Artificial sequence
  specific aptamers
ggaaguggugaggaguggcg

SEQ ID NO: 2759 - RNA, 20 nt, Artificial sequence
  specific aptamers
ggaaguggugaggaguggug

SEQ ID NO: 2760 - RNA, 21 nt, Artificial sequence
  specific aptamers
ggaaguggugagguagaggag

SEQ ID NO: 2761 - RNA, 21 nt, Artificial sequence
  specific aptamers
ggaaguggugagguagaggcg

SEQ ID NO: 2762 - RNA, 21 nt, Artificial sequence
  specific aptamers
ggaaguggugagguagaggug

SEQ ID NO: 2763 - RNA, 21 nt, Artificial sequence
  specific aptamers
ggaaguggugagguagcggag

SEQ ID NO: 2764 - RNA, 21 nt, Artificial sequence
  specific aptamers
ggaaguggugagguagcggcg

SEQ ID NO: 2765 - RNA, 21 nt, Artificial sequence
  specific aptamers
ggaaguggugagguagcggug

SEQ ID NO: 2766 - RNA, 21 nt, Artificial sequence
  specific aptamers
ggaaguggugagguaguggag

SEQ ID NO: 2767 - RNA, 21 nt, Artificial sequence
  specific aptamers
ggaaguggugagguaguggcg

SEQ ID NO: 2768 - RNA, 21 nt, Artificial sequence
  specific aptamers
ggaaguggugagguaguggug

SEQ ID NO: 2769 - RNA, 21 nt, Artificial sequence
  specific aptamers
ggaaguggugagguugaggag

SEQ ID NO: 2770 - RNA, 21 nt, Artificial sequence
  specific aptamers
ggaaguggugagguugaggcg

SEQ ID NO: 2771 - RNA, 21 nt, Artificial sequence
  specific aptamers
ggaaguggugagguugaggug

SEQ ID NO: 2772 - RNA, 21 nt, Artificial sequence
  specific aptamers
ggaaguggugagguugcggag

SEQ ID NO: 2773 - RNA, 21 nt, Artificial sequence
  specific aptamers
ggaaguggugagguugcggcg

SEQ ID NO: 2774 - RNA, 21 nt, Artificial sequence
  specific aptamers
ggaaguggugagguugcggug

SEQ ID NO: 2775 - RNA, 21 nt, Artificial sequence
  specific aptamers
ggaaguggugagguuguggag

SEQ ID NO: 2776 - RNA, 21 nt, Artificial sequence
  specific aptamers
ggaaguggugagguuguggcg

SEQ ID NO: 2777 - RNA, 21 nt, Artificial sequence
  specific aptamers
ggaaguggugagguuguggug

SEQ ID NO: 2778 - RNA, 20 nt, Artificial sequence
  specific aptamers
ggaaguggugaggugaggag

SEQ ID NO: 2779 - RNA, 20 nt, Artificial sequence
  specific aptamers
ggaaguggugaggugaggcg

SEQ ID NO: 2780 - RNA, 20 nt, Artificial sequence
  specific aptamers
ggaaguggugaggugaggug

SEQ ID NO: 2781 - RNA, 20 nt, Artificial sequence
  specific aptamers
ggaaguggugaggugcggag

SEQ ID NO: 2782 - RNA, 20 nt, Artificial sequence
  specific aptamers
ggaaguggugaggugcggcg

SEQ ID NO: 2783 - RNA, 20 nt, Artificial sequence
  specific aptamers
ggaaguggugaggugcggug

SEQ ID NO: 2784 - RNA, 20 nt, Artificial sequence
  specific aptamers
ggaaguggugagguguggag

SEQ ID NO: 2785 - RNA, 20 nt, Artificial sequence
  specific aptamers
ggaaguggugagguguggcg

SEQ ID NO: 2786 - RNA, 20 nt, Artificial sequence
  specific aptamers
ggaaguggugagguguggug

SEQ ID NO: 2787 - RNA, 21 nt, Artificial sequence
  specific aptamers
ggaagugguguggaagaggag

SEQ ID NO: 2788 - RNA, 21 nt, Artificial sequence
  specific aptamers
ggaagugguguggaagaggcg

SEQ ID NO: 2789 - RNA, 21 nt, Artificial sequence
  specific aptamers
ggaagugguguggaagaggug

SEQ ID NO: 2790 - RNA, 21 nt, Artificial sequence
  specific aptamers
ggaagugguguggaagcggag

SEQ ID NO: 2791 - RNA, 21 nt, Artificial sequence
  specific aptamers
ggaagugguguggaagcggcg

SEQ ID NO: 2792 - RNA, 21 nt, Artificial sequence
  specific aptamers
ggaagugguguggaagcggug

SEQ ID NO: 2793 - RNA, 21 nt, Artificial sequence
  specific aptamers
ggaagugguguggaaguggag

SEQ ID NO: 2794 - RNA, 21 nt, Artificial sequence
  specific aptamers
ggaagugguguggaaguggcg

SEQ ID NO: 2795 - RNA, 21 nt, Artificial sequence
  specific aptamers
ggaagugguguggaaguggug

SEQ ID NO: 2796 - RNA, 21 nt, Artificial sequence
  specific aptamers
ggaagugguguggaugaggag

SEQ ID NO: 2797 - RNA, 21 nt, Artificial sequence
  specific aptamers
ggaagugguguggaugaggcg

SEQ ID NO: 2798 - RNA, 21 nt, Artificial sequence
  specific aptamers
ggaagugguguggaugaggug

SEQ ID NO: 2799 - RNA, 21 nt, Artificial sequence
  specific aptamers
ggaagugguguggaugcggag

SEQ ID NO: 2800 - RNA, 21 nt, Artificial sequence
  specific aptamers
ggaagugguguggaugcggcg

SEQ ID NO: 2801 - RNA, 21 nt, Artificial sequence
  specific aptamers
ggaagugguguggaugcggug

SEQ ID NO: 2802 - RNA, 21 nt, Artificial sequence
  specific aptamers
ggaagugguguggauguggag

SEQ ID NO: 2803 - RNA, 21 nt, Artificial sequence
  specific aptamers
ggaagugguguggauguggcg

SEQ ID NO: 2804 - RNA, 21 nt, Artificial sequence
  specific aptamers
ggaagugguguggauguggug

SEQ ID NO: 2805 - RNA, 20 nt, Artificial sequence
  specific aptamers
ggaagugguguggagaggag

SEQ ID NO: 2806 - RNA, 20 nt, Artificial sequence
  specific aptamers
ggaagugguguggagaggcg

SEQ ID NO: 2807 - RNA, 20 nt, Artificial sequence
  specific aptamers
ggaagugguguggagaggug

SEQ ID NO: 2808 - RNA, 20 nt, Artificial sequence
  specific aptamers
ggaagugguguggagcggag

SEQ ID NO: 2809 - RNA, 20 nt, Artificial sequence
  specific aptamers
ggaagugguguggagcggcg

SEQ ID NO: 2810 - RNA, 20 nt, Artificial sequence
  specific aptamers
ggaagugguguggagcggug

SEQ ID NO: 2811 - RNA, 20 nt, Artificial sequence
  specific aptamers
ggaagugguguggaguggag

SEQ ID NO: 2812 - RNA, 20 nt, Artificial sequence
  specific aptamers
ggaagugguguggaguggcg

SEQ ID NO: 2813 - RNA, 20 nt, Artificial sequence
  specific aptamers
ggaagugguguggaguggug

SEQ ID NO: 2814 - RNA, 21 nt, Artificial sequence
  specific aptamers
ggaaguggugugguagaggag

SEQ ID NO: 2815 - RNA, 21 nt, Artificial sequence
  specific aptamers
ggaaguggugugguagaggcg

SEQ ID NO: 2816 - RNA, 21 nt, Artificial sequence
  specific aptamers
ggaaguggugugguagaggug

SEQ ID NO: 2817 - RNA, 21 nt, Artificial sequence
  specific aptamers
ggaaguggugugguagcggag

SEQ ID NO: 2818 - RNA, 21 nt, Artificial sequence
  specific aptamers
ggaaguggugugguagcggcg

SEQ ID NO: 2819 - RNA, 21 nt, Artificial sequence
  specific aptamers
ggaaguggugugguagcggug

SEQ ID NO: 2820 - RNA, 21 nt, Artificial sequence
  specific aptamers
ggaaguggugugguaguggag

SEQ ID NO: 2821 - RNA, 21 nt, Artificial sequence
  specific aptamers
ggaaguggugugguaguggcg

SEQ ID NO: 2822 - RNA, 21 nt, Artificial sequence
  specific aptamers
ggaaguggugugguaguggug

SEQ ID NO: 2823 - RNA, 21 nt, Artificial sequence
  specific aptamers
ggaaguggugugguugaggag

SEQ ID NO: 2824 - RNA, 21 nt, Artificial sequence
  specific aptamers
ggaaguggugugguugaggcg

SEQ ID NO: 2825 - RNA, 21 nt, Artificial sequence
  specific aptamers
ggaaguggugugguugaggug

SEQ ID NO: 2826 - RNA, 21 nt, Artificial sequence
  specific aptamers
ggaaguggugugguugcggag

SEQ ID NO: 2827 - RNA, 21 nt, Artificial sequence
  specific aptamers
ggaaguggugugguugcggcg

SEQ ID NO: 2828 - RNA, 21 nt, Artificial sequence
  specific aptamers
ggaaguggugugguugcggug

SEQ ID NO: 2829 - RNA, 21 nt, Artificial sequence
  specific aptamers
ggaaguggugugguuguggag

SEQ ID NO: 2830 - RNA, 21 nt, Artificial sequence
  specific aptamers
ggaaguggugugguuguggcg

SEQ ID NO: 2831 - RNA, 21 nt, Artificial sequence
  specific aptamers
ggaaguggugugguuguggug

SEQ ID NO: 2832 - RNA, 20 nt, Artificial sequence
  specific aptamers
ggaagugguguggugaggag

SEQ ID NO: 2833 - RNA, 20 nt, Artificial sequence
  specific aptamers
ggaagugguguggugaggcg

SEQ ID NO: 2834 - RNA, 20 nt, Artificial sequence
  specific aptamers
ggaagugguguggugaggug

SEQ ID NO: 2835 - RNA, 20 nt, Artificial sequence
  specific aptamers
ggaagugguguggugcggag

SEQ ID NO: 2836 - RNA, 20 nt, Artificial sequence
  specific aptamers
ggaagugguguggugcggcg

SEQ ID NO: 2837 - RNA, 20 nt, Artificial sequence
  specific aptamers
ggaagugguguggugcggug

SEQ ID NO: 2838 - RNA, 20 nt, Artificial sequence
  specific aptamers
ggaaguggugugguguggag

SEQ ID NO: 2839 - RNA, 20 nt, Artificial sequence
  specific aptamers
ggaaguggugugguguggcg

SEQ ID NO: 2840 - RNA, 20 nt, Artificial sequence
  specific aptamers
ggaaguggugugguguggug

SEQ ID NO: 2841 - RNA, 21 nt, Artificial sequence
  specific aptamers
ggaugaggagaggaagaggag

SEQ ID NO: 2842 - RNA, 21 nt, Artificial sequence
  specific aptamers
ggaugaggagaggaagaggcg

SEQ ID NO: 2843 - RNA, 21 nt, Artificial sequence
  specific aptamers
ggaugaggagaggaagaggug

SEQ ID NO: 2844 - RNA, 21 nt, Artificial sequence
  specific aptamers
ggaugaggagaggaagcggag

SEQ ID NO: 2845 - RNA, 21 nt, Artificial sequence
  specific aptamers
ggaugaggagaggaagcggcg

SEQ ID NO: 2846 - RNA, 21 nt, Artificial sequence
  specific aptamers
ggaugaggagaggaagcggug

SEQ ID NO: 2847 - RNA, 21 nt, Artificial sequence
  specific aptamers
ggaugaggagaggaaguggag

SEQ ID NO: 2848 - RNA, 21 nt, Artificial sequence
  specific aptamers
ggaugaggagaggaaguggcg

SEQ ID NO: 2849 - RNA, 21 nt, Artificial sequence
  specific aptamers
ggaugaggagaggaaguggug

SEQ ID NO: 2850 - RNA, 21 nt, Artificial sequence
  specific aptamers
ggaugaggagaggaugaggag

SEQ ID NO: 2851 - RNA, 21 nt, Artificial sequence
  specific aptamers
ggaugaggagaggaugaggcg

SEQ ID NO: 2852 - RNA, 21 nt, Artificial sequence
  specific aptamers
ggaugaggagaggaugaggug

SEQ ID NO: 2853 - RNA, 21 nt, Artificial sequence
  specific aptamers
ggaugaggagaggaugcggag

SEQ ID NO: 2854 - RNA, 21 nt, Artificial sequence
  specific aptamers
ggaugaggagaggaugcggcg

SEQ ID NO: 2855 - RNA, 21 nt, Artificial sequence
  specific aptamers
ggaugaggagaggaugcggug

SEQ ID NO: 2856 - RNA, 21 nt, Artificial sequence
  specific aptamers
ggaugaggagaggauguggag

SEQ ID NO: 2857 - RNA, 21 nt, Artificial sequence
  specific aptamers
ggaugaggagaggauguggcg

SEQ ID NO: 2858 - RNA, 21 nt, Artificial sequence
  specific aptamers
ggaugaggagaggauguggug

SEQ ID NO: 2859 - RNA, 20 nt, Artificial sequence
  specific aptamers
ggaugaggagaggagaggag

SEQ ID NO: 2860 - RNA, 20 nt, Artificial sequence
  specific aptamers
ggaugaggagaggagaggcg

SEQ ID NO: 2861 - RNA, 20 nt, Artificial sequence
  specific aptamers
ggaugaggagaggagaggug

SEQ ID NO: 2862 - RNA, 20 nt, Artificial sequence
  specific aptamers
ggaugaggagaggagcggag

SEQ ID NO: 2863 - RNA, 20 nt, Artificial sequence
  specific aptamers
ggaugaggagaggagcggcg

SEQ ID NO: 2864 - RNA, 20 nt, Artificial sequence
  specific aptamers
ggaugaggagaggagcggug

SEQ ID NO: 2865 - RNA, 20 nt, Artificial sequence
  specific aptamers
ggaugaggagaggaguggag

SEQ ID NO: 2866 - RNA, 20 nt, Artificial sequence
  specific aptamers
ggaugaggagaggaguggcg

SEQ ID NO: 2867 - RNA, 20 nt, Artificial sequence
  specific aptamers
ggaugaggagaggaguggug

SEQ ID NO: 2868 - RNA, 21 nt, Artificial sequence
  specific aptamers
ggaugaggagagguagaggag

SEQ ID NO: 2869 - RNA, 21 nt, Artificial sequence
  specific aptamers
ggaugaggagagguagaggcg

SEQ ID NO: 2870 - RNA, 21 nt, Artificial sequence
  specific aptamers
ggaugaggagagguagaggug

SEQ ID NO: 2871 - RNA, 21 nt, Artificial sequence
  specific aptamers
ggaugaggagagguagcggag

SEQ ID NO: 2872 - RNA, 21 nt, Artificial sequence
  specific aptamers
ggaugaggagagguagcggcg

SEQ ID NO: 2873 - RNA, 21 nt, Artificial sequence
  specific aptamers
ggaugaggagagguagcggug

SEQ ID NO: 2874 - RNA, 21 nt, Artificial sequence
  specific aptamers
ggaugaggagagguaguggag

SEQ ID NO: 2875 - RNA, 21 nt, Artificial sequence
  specific aptamers
ggaugaggagagguaguggcg

SEQ ID NO: 2876 - RNA, 21 nt, Artificial sequence
  specific aptamers
ggaugaggagagguaguggug

SEQ ID NO: 2877 - RNA, 21 nt, Artificial sequence
  specific aptamers
ggaugaggagagguugaggag

SEQ ID NO: 2878 - RNA, 21 nt, Artificial sequence
  specific aptamers
ggaugaggagagguugaggcg

SEQ ID NO: 2879 - RNA, 21 nt, Artificial sequence
  specific aptamers
ggaugaggagagguugaggug

SEQ ID NO: 2880 - RNA, 21 nt, Artificial sequence
  specific aptamers
ggaugaggagagguugcggag

SEQ ID NO: 2881 - RNA, 21 nt, Artificial sequence
  specific aptamers
ggaugaggagagguugcggcg

SEQ ID NO: 2882 - RNA, 21 nt, Artificial sequence
  specific aptamers
ggaugaggagagguugcggug

SEQ ID NO: 2883 - RNA, 21 nt, Artificial sequence
  specific aptamers
ggaugaggagagguuguggag

SEQ ID NO: 2884 - RNA, 21 nt, Artificial sequence
  specific aptamers
ggaugaggagagguuguggcg

SEQ ID NO: 2885 - RNA, 21 nt, Artificial sequence
  specific aptamers
ggaugaggagagguuguggug

SEQ ID NO: 2886 - RNA, 20 nt, Artificial sequence
  specific aptamers
ggaugaggagaggugaggag

SEQ ID NO: 2887 - RNA, 20 nt, Artificial sequence
  specific aptamers
ggaugaggagaggugaggcg

SEQ ID NO: 2888 - RNA, 20 nt, Artificial sequence
  specific aptamers
ggaugaggagaggugaggug

SEQ ID NO: 2889 - RNA, 20 nt, Artificial sequence
  specific aptamers
ggaugaggagaggugcggag

SEQ ID NO: 2890 - RNA, 20 nt, Artificial sequence
  specific aptamers
ggaugaggagaggugcggcg

SEQ ID NO: 2891 - RNA, 20 nt, Artificial sequence
  specific aptamers
ggaugaggagaggugcggug

SEQ ID NO: 2892 - RNA, 20 nt, Artificial sequence
  specific aptamers
ggaugaggagagguguggag

SEQ ID NO: 2893 - RNA, 20 nt, Artificial sequence
  specific aptamers
ggaugaggagagguguggcg

SEQ ID NO: 2894 - RNA, 20 nt, Artificial sequence
  specific aptamers
ggaugaggagagguguggug

SEQ ID NO: 2895 - RNA, 21 nt, Artificial sequence
  specific aptamers
ggaugaggaguggaagaggag

SEQ ID NO: 2896 - RNA, 21 nt, Artificial sequence
  specific aptamers
ggaugaggaguggaagaggcg

SEQ ID NO: 2897 - RNA, 21 nt, Artificial sequence
  specific aptamers
ggaugaggaguggaagaggug

SEQ ID NO: 2898 - RNA, 21 nt, Artificial sequence
  specific aptamers
ggaugaggaguggaagcggag

SEQ ID NO: 2899 - RNA, 21 nt, Artificial sequence
  specific aptamers
ggaugaggaguggaagcggcg

SEQ ID NO: 2900 - RNA, 21 nt, Artificial sequence
  specific aptamers
ggaugaggaguggaagcggug

SEQ ID NO: 2901 - RNA, 21 nt, Artificial sequence
  specific aptamers
ggaugaggaguggaaguggag

SEQ ID NO: 2902 - RNA, 21 nt, Artificial sequence
  specific aptamers
ggaugaggaguggaaguggcg

SEQ ID NO: 2903 - RNA, 21 nt, Artificial sequence
  specific aptamers
ggaugaggaguggaaguggug

SEQ ID NO: 2904 - RNA, 21 nt, Artificial sequence
  specific aptamers
ggaugaggaguggaugaggag

SEQ ID NO: 2905 - RNA, 21 nt, Artificial sequence
  specific aptamers
ggaugaggaguggaugaggcg

SEQ ID NO: 2906 - RNA, 21 nt, Artificial sequence
  specific aptamers
ggaugaggaguggaugaggug

SEQ ID NO: 2907 - RNA, 21 nt, Artificial sequence
  specific aptamers
ggaugaggaguggaugcggag

SEQ ID NO: 2908 - RNA, 21 nt, Artificial sequence
  specific aptamers
ggaugaggaguggaugcggcg

SEQ ID NO: 2909 - RNA, 21 nt, Artificial sequence
  specific aptamers
ggaugaggaguggaugcggug

SEQ ID NO: 2910 - RNA, 21 nt, Artificial sequence
  specific aptamers
ggaugaggaguggauguggag

SEQ ID NO: 2911 - RNA, 21 nt, Artificial sequence
  specific aptamers
ggaugaggaguggauguggcg

SEQ ID NO: 2912 - RNA, 21 nt, Artificial sequence
  specific aptamers
ggaugaggaguggauguggug

SEQ ID NO: 2913 - RNA, 20 nt, Artificial sequence
  specific aptamers
ggaugaggaguggagaggag

SEQ ID NO: 2914 - RNA, 20 nt, Artificial sequence
  specific aptamers
ggaugaggaguggagaggcg

SEQ ID NO: 2915 - RNA, 20 nt, Artificial sequence
  specific aptamers
ggaugaggaguggagaggug

SEQ ID NO: 2916 - RNA, 20 nt, Artificial sequence
  specific aptamers
ggaugaggaguggagcggag

SEQ ID NO: 2917 - RNA, 20 nt, Artificial sequence
  specific aptamers
ggaugaggaguggagcggcg

SEQ ID NO: 2918 - RNA, 20 nt, Artificial sequence
  specific aptamers
ggaugaggaguggagcggug

SEQ ID NO: 2919 - RNA, 20 nt, Artificial sequence
  specific aptamers
ggaugaggaguggaguggag

SEQ ID NO: 2920 - RNA, 20 nt, Artificial sequence
  specific aptamers
ggaugaggaguggaguggcg

SEQ ID NO: 2921 - RNA, 20 nt, Artificial sequence
  specific aptamers
ggaugaggaguggaguggug

SEQ ID NO: 2922 - RNA, 21 nt, Artificial sequence
  specific aptamers
ggaugaggagugguagaggag

SEQ ID NO: 2923 - RNA, 21 nt, Artificial sequence
  specific aptamers
ggaugaggagugguagaggcg

SEQ ID NO: 2924 - RNA, 21 nt, Artificial sequence
  specific aptamers
ggaugaggagugguagaggug

SEQ ID NO: 2925 - RNA, 21 nt, Artificial sequence
  specific aptamers
ggaugaggagugguagcggag

SEQ ID NO: 2926 - RNA, 21 nt, Artificial sequence
  specific aptamers
ggaugaggagugguagcggcg

SEQ ID NO: 2927 - RNA, 21 nt, Artificial sequence
  specific aptamers
ggaugaggagugguagcggug

SEQ ID NO: 2928 - RNA, 21 nt, Artificial sequence
  specific aptamers
ggaugaggagugguaguggag

SEQ ID NO: 2929 - RNA, 21 nt, Artificial sequence
  specific aptamers
ggaugaggagugguaguggcg

SEQ ID NO: 2930 - RNA, 21 nt, Artificial sequence
  specific aptamers
ggaugaggagugguaguggug

SEQ ID NO: 2931 - RNA, 21 nt, Artificial sequence
  specific aptamers
ggaugaggagugguugaggag

SEQ ID NO: 2932 - RNA, 21 nt, Artificial sequence
  specific aptamers
ggaugaggagugguugaggcg

SEQ ID NO: 2933 - RNA, 21 nt, Artificial sequence
  specific aptamers
ggaugaggagugguugaggug

SEQ ID NO: 2934 - RNA, 21 nt, Artificial sequence
  specific aptamers
ggaugaggagugguugcggag

SEQ ID NO: 2935 - RNA, 21 nt, Artificial sequence
  specific aptamers
ggaugaggagugguugcggcg

SEQ ID NO: 2936 - RNA, 21 nt, Artificial sequence
  specific aptamers
ggaugaggagugguugcggug

SEQ ID NO: 2937 - RNA, 21 nt, Artificial sequence
  specific aptamers
ggaugaggagugguuguggag

SEQ ID NO: 2938 - RNA, 21 nt, Artificial sequence
  specific aptamers
ggaugaggagugguuguggcg

SEQ ID NO: 2939 - RNA, 21 nt, Artificial sequence
  specific aptamers
ggaugaggagugguuguggug

SEQ ID NO: 2940 - RNA, 20 nt, Artificial sequence
  specific aptamers
ggaugaggaguggugaggag

SEQ ID NO: 2941 - RNA, 20 nt, Artificial sequence
  specific aptamers
ggaugaggaguggugaggcg

SEQ ID NO: 2942 - RNA, 20 nt, Artificial sequence
  specific aptamers
ggaugaggaguggugaggug

SEQ ID NO: 2943 - RNA, 20 nt, Artificial sequence
  specific aptamers
ggaugaggaguggugcggag

SEQ ID NO: 2944 - RNA, 20 nt, Artificial sequence
  specific aptamers
ggaugaggaguggugcggcg

SEQ ID NO: 2945 - RNA, 20 nt, Artificial sequence
  specific aptamers
ggaugaggaguggugcggug

SEQ ID NO: 2946 - RNA, 20 nt, Artificial sequence
  specific aptamers
ggaugaggagugguguggag

SEQ ID NO: 2947 - RNA, 20 nt, Artificial sequence
  specific aptamers
ggaugaggagugguguggcg

SEQ ID NO: 2948 - RNA, 20 nt, Artificial sequence
  specific aptamers
ggaugaggagugguguggug

SEQ ID NO: 2949 - RNA, 21 nt, Artificial sequence
  specific aptamers
ggaugaggugaggaagaggag

SEQ ID NO: 2950 - RNA, 21 nt, Artificial sequence
  specific aptamers
ggaugaggugaggaagaggcg

SEQ ID NO: 2951 - RNA, 21 nt, Artificial sequence
  specific aptamers
ggaugaggugaggaagaggug

SEQ ID NO: 2952 - RNA, 21 nt, Artificial sequence
  specific aptamers
ggaugaggugaggaagcggag

SEQ ID NO: 2953 - RNA, 21 nt, Artificial sequence
  specific aptamers
ggaugaggugaggaagcggcg

SEQ ID NO: 2954 - RNA, 21 nt, Artificial sequence
  specific aptamers
ggaugaggugaggaagcggug

SEQ ID NO: 2955 - RNA, 21 nt, Artificial sequence
  specific aptamers
ggaugaggugaggaaguggag

SEQ ID NO: 2956 - RNA, 21 nt, Artificial sequence
  specific aptamers
ggaugaggugaggaaguggcg

SEQ ID NO: 2957 - RNA, 21 nt, Artificial sequence
  specific aptamers
ggaugaggugaggaaguggug

SEQ ID NO: 2958 - RNA, 21 nt, Artificial sequence
  specific aptamers
ggaugaggugaggaugaggag

SEQ ID NO: 2959 - RNA, 21 nt, Artificial sequence
  specific aptamers
ggaugaggugaggaugaggcg

SEQ ID NO: 2960 - RNA, 21 nt, Artificial sequence
  specific aptamers
ggaugaggugaggaugaggug

SEQ ID NO: 2961 - RNA, 21 nt, Artificial sequence
  specific aptamers
ggaugaggugaggaugcggag

SEQ ID NO: 2962 - RNA, 21 nt, Artificial sequence
  specific aptamers
ggaugaggugaggaugcggcg

SEQ ID NO: 2963 - RNA, 21 nt, Artificial sequence
  specific aptamers
ggaugaggugaggaugcggug

SEQ ID NO: 2964 - RNA, 21 nt, Artificial sequence
  specific aptamers
ggaugaggugaggauguggag

SEQ ID NO: 2965 - RNA, 21 nt, Artificial sequence
  specific aptamers
ggaugaggugaggauguggcg

SEQ ID NO: 2966 - RNA, 21 nt, Artificial sequence
  specific aptamers
ggaugaggugaggauguggug

SEQ ID NO: 2967 - RNA, 20 nt, Artificial sequence
  specific aptamers
ggaugaggugaggagaggag

SEQ ID NO: 2968 - RNA, 20 nt, Artificial sequence
  specific aptamers
ggaugaggugaggagaggcg

SEQ ID NO: 2969 - RNA, 20 nt, Artificial sequence
  specific aptamers
ggaugaggugaggagaggug

SEQ ID NO: 2970 - RNA, 20 nt, Artificial sequence
  specific aptamers
ggaugaggugaggagcggag

SEQ ID NO: 2971 - RNA, 20 nt, Artificial sequence
  specific aptamers
ggaugaggugaggagcggcg

SEQ ID NO: 2972 - RNA, 20 nt, Artificial sequence
  specific aptamers
ggaugaggugaggagcggug

SEQ ID NO: 2973 - RNA, 20 nt, Artificial sequence
  specific aptamers
ggaugaggugaggaguggag

SEQ ID NO: 2974 - RNA, 20 nt, Artificial sequence
  specific aptamers
ggaugaggugaggaguggcg

SEQ ID NO: 2975 - RNA, 20 nt, Artificial sequence
  specific aptamers
ggaugaggugaggaguggug

SEQ ID NO: 2976 - RNA, 21 nt, Artificial sequence
  specific aptamers
ggaugaggugagguagaggag

SEQ ID NO: 2977 - RNA, 21 nt, Artificial sequence
  specific aptamers
ggaugaggugagguagaggcg

SEQ ID NO: 2978 - RNA, 21 nt, Artificial sequence
  specific aptamers
ggaugaggugagguagaggug

SEQ ID NO: 2979 - RNA, 21 nt, Artificial sequence
  specific aptamers
ggaugaggugagguagcggag

SEQ ID NO: 2980 - RNA, 21 nt, Artificial sequence
  specific aptamers
ggaugaggugagguagcggcg

SEQ ID NO: 2981 - RNA, 21 nt, Artificial sequence
  specific aptamers
ggaugaggugagguagcggug

SEQ ID NO: 2982 - RNA, 21 nt, Artificial sequence
  specific aptamers
ggaugaggugagguaguggag

SEQ ID NO: 2983 - RNA, 21 nt, Artificial sequence
  specific aptamers
ggaugaggugagguaguggcg

SEQ ID NO: 2984 - RNA, 21 nt, Artificial sequence
  specific aptamers
ggaugaggugagguaguggug

SEQ ID NO: 2985 - RNA, 21 nt, Artificial sequence
  specific aptamers
ggaugaggugagguugaggag

SEQ ID NO: 2986 - RNA, 21 nt, Artificial sequence
  specific aptamers
ggaugaggugagguugaggcg

SEQ ID NO: 2987 - RNA, 21 nt, Artificial sequence
  specific aptamers
ggaugaggugagguugaggug

SEQ ID NO: 2988 - RNA, 21 nt, Artificial sequence
  specific aptamers
ggaugaggugagguugcggag

SEQ ID NO: 2989 - RNA, 21 nt, Artificial sequence
  specific aptamers
ggaugaggugagguugcggcg

SEQ ID NO: 2990 - RNA, 21 nt, Artificial sequence
  specific aptamers
ggaugaggugagguugcggug

SEQ ID NO: 2991 - RNA, 21 nt, Artificial sequence
  specific aptamers
ggaugaggugagguuguggag

SEQ ID NO: 2992 - RNA, 21 nt, Artificial sequence
  specific aptamers
ggaugaggugagguuguggcg

SEQ ID NO: 2993 - RNA, 21 nt, Artificial sequence
  specific aptamers
ggaugaggugagguuguggug

SEQ ID NO: 2994 - RNA, 20 nt, Artificial sequence
  specific aptamers
ggaugaggugaggugaggag

SEQ ID NO: 2995 - RNA, 20 nt, Artificial sequence
  specific aptamers
ggaugaggugaggugaggcg

SEQ ID NO: 2996 - RNA, 20 nt, Artificial sequence
  specific aptamers
ggaugaggugaggugaggug

SEQ ID NO: 2997 - RNA, 20 nt, Artificial sequence
  specific aptamers
ggaugaggugaggugcggag

SEQ ID NO: 2998 - RNA, 20 nt, Artificial sequence
  specific aptamers
ggaugaggugaggugcggcg

SEQ ID NO: 2999 - RNA, 20 nt, Artificial sequence
  specific aptamers
ggaugaggugaggugcggug

SEQ ID NO: 3000 - RNA, 20 nt, Artificial sequence
  specific aptamers
ggaugaggugagguguggag

SEQ ID NO: 3001 - RNA, 20 nt, Artificial sequence
  specific aptamers
ggaugaggugagguguggcg

SEQ ID NO: 3002 - RNA, 20 nt, Artificial sequence
  specific aptamers
ggaugaggugagguguggug

SEQ ID NO: 3003 - RNA, 21 nt, Artificial sequence
  specific aptamers
ggaugagguguggaagaggag

SEQ ID NO: 3004 - RNA, 21 nt, Artificial sequence
  specific aptamers
ggaugagguguggaagaggcg

SEQ ID NO: 3005 - RNA, 21 nt, Artificial sequence
  specific aptamers
ggaugagguguggaagaggug

SEQ ID NO: 3006 - RNA, 21 nt, Artificial sequence
  specific aptamers
ggaugagguguggaagcggag

SEQ ID NO: 3007 - RNA, 21 nt, Artificial sequence
  specific aptamers
ggaugagguguggaagcggcg

SEQ ID NO: 3008 - RNA, 21 nt, Artificial sequence
  specific aptamers
ggaugagguguggaagcggug

SEQ ID NO: 3009 - RNA, 21 nt, Artificial sequence
  specific aptamers
ggaugagguguggaaguggag

SEQ ID NO: 3010 - RNA, 21 nt, Artificial sequence
  specific aptamers
ggaugagguguggaaguggcg

SEQ ID NO: 3011 - RNA, 21 nt, Artificial sequence
  specific aptamers
ggaugagguguggaaguggug

SEQ ID NO: 3012 - RNA, 21 nt, Artificial sequence
  specific aptamers
ggaugagguguggaugaggag

SEQ ID NO: 3013 - RNA, 21 nt, Artificial sequence
  specific aptamers
ggaugagguguggaugaggcg

SEQ ID NO: 3014 - RNA, 21 nt, Artificial sequence
  specific aptamers
ggaugagguguggaugaggug

SEQ ID NO: 3015 - RNA, 21 nt, Artificial sequence
  specific aptamers
ggaugagguguggaugcggag

SEQ ID NO: 3016 - RNA, 21 nt, Artificial sequence
  specific aptamers
ggaugagguguggaugcggcg

SEQ ID NO: 3017 - RNA, 21 nt, Artificial sequence
  specific aptamers
ggaugagguguggaugcggug

SEQ ID NO: 3018 - RNA, 21 nt, Artificial sequence
  specific aptamers
ggaugagguguggauguggag

SEQ ID NO: 3019 - RNA, 21 nt, Artificial sequence
  specific aptamers
ggaugagguguggauguggcg

SEQ ID NO: 3020 - RNA, 21 nt, Artificial sequence
  specific aptamers
ggaugagguguggauguggug

SEQ ID NO: 3021 - RNA, 20 nt, Artificial sequence
  specific aptamers
ggaugagguguggagaggag

SEQ ID NO: 3022 - RNA, 20 nt, Artificial sequence
  specific aptamers
ggaugagguguggagaggcg

SEQ ID NO: 3023 - RNA, 20 nt, Artificial sequence
  specific aptamers
ggaugagguguggagaggug

SEQ ID NO: 3024 - RNA, 20 nt, Artificial sequence
  specific aptamers
ggaugagguguggagcggag

SEQ ID NO: 3025 - RNA, 20 nt, Artificial sequence
  specific aptamers
ggaugagguguggagcggcg

SEQ ID NO: 3026 - RNA, 20 nt, Artificial sequence
  specific aptamers
ggaugagguguggagcggug

SEQ ID NO: 3027 - RNA, 20 nt, Artificial sequence
  specific aptamers
ggaugagguguggaguggag

SEQ ID NO: 3028 - RNA, 20 nt, Artificial sequence
  specific aptamers
ggaugagguguggaguggcg

SEQ ID NO: 3029 - RNA, 20 nt, Artificial sequence
  specific aptamers
ggaugagguguggaguggug

SEQ ID NO: 3030 - RNA, 21 nt, Artificial sequence
  specific aptamers
ggaugaggugugguagaggag

SEQ ID NO: 3031 - RNA, 21 nt, Artificial sequence
  specific aptamers
ggaugaggugugguagaggcg

SEQ ID NO: 3032 - RNA, 21 nt, Artificial sequence
  specific aptamers
ggaugaggugugguagaggug

SEQ ID NO: 3033 - RNA, 21 nt, Artificial sequence
  specific aptamers
ggaugaggugugguagcggag

SEQ ID NO: 3034 - RNA, 21 nt, Artificial sequence
  specific aptamers
ggaugaggugugguagcggcg

SEQ ID NO: 3035 - RNA, 21 nt, Artificial sequence
  specific aptamers
ggaugaggugugguagcggug

SEQ ID NO: 3036 - RNA, 21 nt, Artificial sequence
  specific aptamers
ggaugaggugugguaguggag

SEQ ID NO: 3037 - RNA, 21 nt, Artificial sequence
  specific aptamers
ggaugaggugugguaguggcg

SEQ ID NO: 3038 - RNA, 21 nt, Artificial sequence
  specific aptamers
ggaugaggugugguaguggug

SEQ ID NO: 3039 - RNA, 21 nt, Artificial sequence
  specific aptamers
ggaugaggugugguugaggag

SEQ ID NO: 3040 - RNA, 21 nt, Artificial sequence
  specific aptamers
ggaugaggugugguugaggcg

SEQ ID NO: 3041 - RNA, 21 nt, Artificial sequence
  specific aptamers
ggaugaggugugguugaggug

SEQ ID NO: 3042 - RNA, 21 nt, Artificial sequence
  specific aptamers
ggaugaggugugguugcggag

SEQ ID NO: 3043 - RNA, 21 nt, Artificial sequence
  specific aptamers
ggaugaggugugguugcggcg

SEQ ID NO: 3044 - RNA, 21 nt, Artificial sequence
  specific aptamers
ggaugaggugugguugcggug

SEQ ID NO: 3045 - RNA, 21 nt, Artificial sequence
  specific aptamers
ggaugaggugugguuguggag

SEQ ID NO: 3046 - RNA, 21 nt, Artificial sequence
  specific aptamers
ggaugaggugugguuguggcg

SEQ ID NO: 3047 - RNA, 21 nt, Artificial sequence
  specific aptamers
ggaugaggugugguuguggug

SEQ ID NO: 3048 - RNA, 20 nt, Artificial sequence
  specific aptamers
ggaugagguguggugaggag

SEQ ID NO: 3049 - RNA, 20 nt, Artificial sequence
  specific aptamers
ggaugagguguggugaggcg

SEQ ID NO: 3050 - RNA, 20 nt, Artificial sequence
  specific aptamers
ggaugagguguggugaggug

SEQ ID NO: 3051 - RNA, 20 nt, Artificial sequence
  specific aptamers
ggaugagguguggugcggag

SEQ ID NO: 3052 - RNA, 20 nt, Artificial sequence
  specific aptamers
ggaugagguguggugcggcg

SEQ ID NO: 3053 - RNA, 20 nt, Artificial sequence
  specific aptamers
ggaugagguguggugcggug

SEQ ID NO: 3054 - RNA, 20 nt, Artificial sequence
  specific aptamers
ggaugaggugugguguggag

SEQ ID NO: 3055 - RNA, 20 nt, Artificial sequence
  specific aptamers
ggaugaggugugguguggcg

SEQ ID NO: 3056 - RNA, 20 nt, Artificial sequence
  specific aptamers
ggaugaggugugguguggug

SEQ ID NO: 3057 - RNA, 21 nt, Artificial sequence
  specific aptamers
ggauguggagaggaagaggag

SEQ ID NO: 3058 - RNA, 21 nt, Artificial sequence
  specific aptamers
ggauguggagaggaagaggcg

SEQ ID NO: 3059 - RNA, 21 nt, Artificial sequence
  specific aptamers
ggauguggagaggaagaggug

SEQ ID NO: 3060 - RNA, 21 nt, Artificial sequence
  specific aptamers
ggauguggagaggaagcggag

SEQ ID NO: 3061 - RNA, 21 nt, Artificial sequence
  specific aptamers
ggauguggagaggaagcggcg

SEQ ID NO: 3062 - RNA, 21 nt, Artificial sequence
  specific aptamers
ggauguggagaggaagcggug

SEQ ID NO: 3063 - RNA, 21 nt, Artificial sequence
  specific aptamers
ggauguggagaggaaguggag

SEQ ID NO: 3064 - RNA, 21 nt, Artificial sequence
  specific aptamers
ggauguggagaggaaguggcg

SEQ ID NO: 3065 - RNA, 21 nt, Artificial sequence
  specific aptamers
ggauguggagaggaaguggug

SEQ ID NO: 3066 - RNA, 21 nt, Artificial sequence
  specific aptamers
ggauguggagaggaugaggag

SEQ ID NO: 3067 - RNA, 21 nt, Artificial sequence
  specific aptamers
ggauguggagaggaugaggcg

SEQ ID NO: 3068 - RNA, 21 nt, Artificial sequence
  specific aptamers
ggauguggagaggaugaggug

SEQ ID NO: 3069 - RNA, 21 nt, Artificial sequence
  specific aptamers
ggauguggagaggaugcggag

SEQ ID NO: 3070 - RNA, 21 nt, Artificial sequence
  specific aptamers
ggauguggagaggaugcggcg

SEQ ID NO: 3071 - RNA, 21 nt, Artificial sequence
  specific aptamers
ggauguggagaggaugcggug

SEQ ID NO: 3072 - RNA, 21 nt, Artificial sequence
  specific aptamers
ggauguggagaggauguggag

SEQ ID NO: 3073 - RNA, 21 nt, Artificial sequence
  specific aptamers
ggauguggagaggauguggcg

SEQ ID NO: 3074 - RNA, 21 nt, Artificial sequence
  specific aptamers
ggauguggagaggauguggug

SEQ ID NO: 3075 - RNA, 20 nt, Artificial sequence
  specific aptamers
ggauguggagaggagaggag

SEQ ID NO: 3076 - RNA, 20 nt, Artificial sequence
  specific aptamers
ggauguggagaggagaggcg

SEQ ID NO: 3077 - RNA, 20 nt, Artificial sequence
  specific aptamers
ggauguggagaggagaggug

SEQ ID NO: 3078 - RNA, 20 nt, Artificial sequence
  specific aptamers
ggauguggagaggagcggag

SEQ ID NO: 3079 - RNA, 20 nt, Artificial sequence
  specific aptamers
ggauguggagaggagcggcg

SEQ ID NO: 3080 - RNA, 20 nt, Artificial sequence
  specific aptamers
ggauguggagaggagcggug

SEQ ID NO: 3081 - RNA, 20 nt, Artificial sequence
  specific aptamers
ggauguggagaggaguggag

SEQ ID NO: 3082 - RNA, 20 nt, Artificial sequence
  specific aptamers
ggauguggagaggaguggcg

SEQ ID NO: 3083 - RNA, 20 nt, Artificial sequence
  specific aptamers
ggauguggagaggaguggug

SEQ ID NO: 3084 - RNA, 21 nt, Artificial sequence
  specific aptamers
ggauguggagagguagaggag

SEQ ID NO: 3085 - RNA, 21 nt, Artificial sequence
  specific aptamers
ggauguggagagguagaggcg

SEQ ID NO: 3086 - RNA, 21 nt, Artificial sequence
  specific aptamers
ggauguggagagguagaggug

SEQ ID NO: 3087 - RNA, 21 nt, Artificial sequence
  specific aptamers
ggauguggagagguagcggag

SEQ ID NO: 3088 - RNA, 21 nt, Artificial sequence
  specific aptamers
ggauguggagagguagcggcg

SEQ ID NO: 3089 - RNA, 21 nt, Artificial sequence
  specific aptamers
ggauguggagagguagcggug

SEQ ID NO: 3090 - RNA, 21 nt, Artificial sequence
  specific aptamers
ggauguggagagguaguggag

SEQ ID NO: 3091 - RNA, 21 nt, Artificial sequence
  specific aptamers
ggauguggagagguaguggcg

SEQ ID NO: 3092 - RNA, 21 nt, Artificial sequence
  specific aptamers
ggauguggagagguaguggug

SEQ ID NO: 3093 - RNA, 21 nt, Artificial sequence
  specific aptamers
ggauguggagagguugaggag

SEQ ID NO: 3094 - RNA, 21 nt, Artificial sequence
  specific aptamers
ggauguggagagguugaggcg

SEQ ID NO: 3095 - RNA, 21 nt, Artificial sequence
  specific aptamers
ggauguggagagguugaggug

SEQ ID NO: 3096 - RNA, 21 nt, Artificial sequence
  specific aptamers
ggauguggagagguugcggag

SEQ ID NO: 3097 - RNA, 21 nt, Artificial sequence
  specific aptamers
ggauguggagagguugcggcg

SEQ ID NO: 3098 - RNA, 21 nt, Artificial sequence
  specific aptamers
ggauguggagagguugcggug

SEQ ID NO: 3099 - RNA, 21 nt, Artificial sequence
  specific aptamers
ggauguggagagguuguggag

SEQ ID NO: 3100 - RNA, 21 nt, Artificial sequence
  specific aptamers
ggauguggagagguuguggcg

SEQ ID NO: 3101 - RNA, 21 nt, Artificial sequence
  specific aptamers
ggauguggagagguuguggug

SEQ ID NO: 3102 - RNA, 20 nt, Artificial sequence
  specific aptamers
ggauguggagaggugaggag

SEQ ID NO: 3103 - RNA, 20 nt, Artificial sequence
  specific aptamers
ggauguggagaggugaggcg

SEQ ID NO: 3104 - RNA, 20 nt, Artificial sequence
  specific aptamers
ggauguggagaggugaggug

SEQ ID NO: 3105 - RNA, 20 nt, Artificial sequence
  specific aptamers
ggauguggagaggugcggag

SEQ ID NO: 3106 - RNA, 20 nt, Artificial sequence
  specific aptamers
ggauguggagaggugcggcg

SEQ ID NO: 3107 - RNA, 20 nt, Artificial sequence
  specific aptamers
ggauguggagaggugcggug

SEQ ID NO: 3108 - RNA, 20 nt, Artificial sequence
  specific aptamers
ggauguggagagguguggag

SEQ ID NO: 3109 - RNA, 20 nt, Artificial sequence
  specific aptamers
ggauguggagagguguggcg

SEQ ID NO: 3110 - RNA, 20 nt, Artificial sequence
  specific aptamers
ggauguggagagguguggug

SEQ ID NO: 3111 - RNA, 21 nt, Artificial sequence
  specific aptamers
ggauguggaguggaagaggag

SEQ ID NO: 3112 - RNA, 21 nt, Artificial sequence
  specific aptamers
ggauguggaguggaagaggcg

SEQ ID NO: 3113 - RNA, 21 nt, Artificial sequence
  specific aptamers
ggauguggaguggaagaggug

SEQ ID NO: 3114 - RNA, 21 nt, Artificial sequence
  specific aptamers
ggauguggaguggaagcggag

SEQ ID NO: 3115 - RNA, 21 nt, Artificial sequence
  specific aptamers
ggauguggaguggaagcggcg

SEQ ID NO: 3116 - RNA, 21 nt, Artificial sequence
  specific aptamers
ggauguggaguggaagcggug

SEQ ID NO: 3117 - RNA, 21 nt, Artificial sequence
  specific aptamers
ggauguggaguggaaguggag

SEQ ID NO: 3118 - RNA, 21 nt, Artificial sequence
  specific aptamers
ggauguggaguggaaguggcg

SEQ ID NO: 3119 - RNA, 21 nt, Artificial sequence
  specific aptamers
ggauguggaguggaaguggug

SEQ ID NO: 3120 - RNA, 21 nt, Artificial sequence
  specific aptamers
ggauguggaguggaugaggag

SEQ ID NO: 3121 - RNA, 21 nt, Artificial sequence
  specific aptamers
ggauguggaguggaugaggcg

SEQ ID NO: 3122 - RNA, 21 nt, Artificial sequence
  specific aptamers
ggauguggaguggaugaggug

SEQ ID NO: 3123 - RNA, 21 nt, Artificial sequence
  specific aptamers
ggauguggaguggaugcggag

SEQ ID NO: 3124 - RNA, 21 nt, Artificial sequence
  specific aptamers
ggauguggaguggaugcggcg

SEQ ID NO: 3125 - RNA, 21 nt, Artificial sequence
  specific aptamers
ggauguggaguggaugcggug

SEQ ID NO: 3126 - RNA, 21 nt, Artificial sequence
  specific aptamers
ggauguggaguggauguggag

SEQ ID NO: 3127 - RNA, 21 nt, Artificial sequence
  specific aptamers
ggauguggaguggauguggcg

SEQ ID NO: 3128 - RNA, 21 nt, Artificial sequence
  specific aptamers
ggauguggaguggauguggug

SEQ ID NO: 3129 - RNA, 20 nt, Artificial sequence
  specific aptamers
ggauguggaguggagaggag

SEQ ID NO: 3130 - RNA, 20 nt, Artificial sequence
  specific aptamers
ggauguggaguggagaggcg

SEQ ID NO: 3131 - RNA, 20 nt, Artificial sequence
  specific aptamers
ggauguggaguggagaggug

SEQ ID NO: 3132 - RNA, 20 nt, Artificial sequence
  specific aptamers
ggauguggaguggagcggag

SEQ ID NO: 3133 - RNA, 20 nt, Artificial sequence
  specific aptamers
ggauguggaguggagcggcg

SEQ ID NO: 3134 - RNA, 20 nt, Artificial sequence
  specific aptamers
ggauguggaguggagcggug

SEQ ID NO: 3135 - RNA, 20 nt, Artificial sequence
  specific aptamers
ggauguggaguggaguggag

SEQ ID NO: 3136 - RNA, 20 nt, Artificial sequence
  specific aptamers
ggauguggaguggaguggcg

SEQ ID NO: 3137 - RNA, 20 nt, Artificial sequence
  specific aptamers
ggauguggaguggaguggug

SEQ ID NO: 3138 - RNA, 21 nt, Artificial sequence
  specific aptamers
ggauguggagugguagaggag

SEQ ID NO: 3139 - RNA, 21 nt, Artificial sequence
  specific aptamers
ggauguggagugguagaggcg

SEQ ID NO: 3140 - RNA, 21 nt, Artificial sequence
  specific aptamers
ggauguggagugguagaggug

SEQ ID NO: 3141 - RNA, 21 nt, Artificial sequence
  specific aptamers
ggauguggagugguagcggag

SEQ ID NO: 3142 - RNA, 21 nt, Artificial sequence
  specific aptamers
ggauguggagugguagcggcg

SEQ ID NO: 3143 - RNA, 21 nt, Artificial sequence
  specific aptamers
ggauguggagugguagcggug

SEQ ID NO: 3144 - RNA, 21 nt, Artificial sequence
  specific aptamers
ggauguggagugguaguggag

SEQ ID NO: 3145 - RNA, 21 nt, Artificial sequence
  specific aptamers
ggauguggagugguaguggcg

SEQ ID NO: 3146 - RNA, 21 nt, Artificial sequence
  specific aptamers
ggauguggagugguaguggug

SEQ ID NO: 3147 - RNA, 21 nt, Artificial sequence
  specific aptamers
ggauguggagugguugaggag

SEQ ID NO: 3148 - RNA, 21 nt, Artificial sequence
  specific aptamers
ggauguggagugguugaggcg

SEQ ID NO: 3149 - RNA, 21 nt, Artificial sequence
  specific aptamers
ggauguggagugguugaggug

SEQ ID NO: 3150 - RNA, 21 nt, Artificial sequence
  specific aptamers
ggauguggagugguugcggag

SEQ ID NO: 3151 - RNA, 21 nt, Artificial sequence
  specific aptamers
ggauguggagugguugcggcg

SEQ ID NO: 3152 - RNA, 21 nt, Artificial sequence
  specific aptamers
ggauguggagugguugcggug

SEQ ID NO: 3153 - RNA, 21 nt, Artificial sequence
  specific aptamers
ggauguggagugguuguggag

SEQ ID NO: 3154 - RNA, 21 nt, Artificial sequence
  specific aptamers
ggauguggagugguuguggcg

SEQ ID NO: 3155 - RNA, 21 nt, Artificial sequence
  specific aptamers
ggauguggagugguuguggug

SEQ ID NO: 3156 - RNA, 20 nt, Artificial sequence
  specific aptamers
ggauguggaguggugaggag

SEQ ID NO: 3157 - RNA, 20 nt, Artificial sequence
  specific aptamers
ggauguggaguggugaggcg

SEQ ID NO: 3158 - RNA, 20 nt, Artificial sequence
  specific aptamers
ggauguggaguggugaggug

SEQ ID NO: 3159 - RNA, 20 nt, Artificial sequence
  specific aptamers
ggauguggaguggugcggag

SEQ ID NO: 3160 - RNA, 20 nt, Artificial sequence
  specific aptamers
ggauguggaguggugcggcg

SEQ ID NO: 3161 - RNA, 20 nt, Artificial sequence
  specific aptamers
ggauguggaguggugcggug

SEQ ID NO: 3162 - RNA, 20 nt, Artificial sequence
  specific aptamers
ggauguggagugguguggag

SEQ ID NO: 3163 - RNA, 20 nt, Artificial sequence
  specific aptamers
ggauguggagugguguggcg

SEQ ID NO: 3164 - RNA, 20 nt, Artificial sequence
  specific aptamers
ggauguggagugguguggug

SEQ ID NO: 3165 - RNA, 21 nt, Artificial sequence
  specific aptamers
ggauguggugaggaagaggag

SEQ ID NO: 3166 - RNA, 21 nt, Artificial sequence
  specific aptamers
ggauguggugaggaagaggcg

SEQ ID NO: 3167 - RNA, 21 nt, Artificial sequence
  specific aptamers
ggauguggugaggaagaggug

SEQ ID NO: 3168 - RNA, 21 nt, Artificial sequence
  specific aptamers
ggauguggugaggaagcggag

SEQ ID NO: 3169 - RNA, 21 nt, Artificial sequence
  specific aptamers
ggauguggugaggaagcggcg

SEQ ID NO: 3170 - RNA, 21 nt, Artificial sequence
  specific aptamers
ggauguggugaggaagcggug

SEQ ID NO: 3171 - RNA, 21 nt, Artificial sequence
  specific aptamers
ggauguggugaggaaguggag

SEQ ID NO: 3172 - RNA, 21 nt, Artificial sequence
  specific aptamers
ggauguggugaggaaguggcg

SEQ ID NO: 3173 - RNA, 21 nt, Artificial sequence
  specific aptamers
ggauguggugaggaaguggug

SEQ ID NO: 3174 - RNA, 21 nt, Artificial sequence
  specific aptamers
ggauguggugaggaugaggag

SEQ ID NO: 3175 - RNA, 21 nt, Artificial sequence
  specific aptamers
ggauguggugaggaugaggcg

SEQ ID NO: 3176 - RNA, 21 nt, Artificial sequence
  specific aptamers
ggauguggugaggaugaggug

SEQ ID NO: 3177 - RNA, 21 nt, Artificial sequence
  specific aptamers
ggauguggugaggaugcggag

SEQ ID NO: 3178 - RNA, 21 nt, Artificial sequence
  specific aptamers
ggauguggugaggaugcggcg

SEQ ID NO: 3179 - RNA, 21 nt, Artificial sequence
  specific aptamers
ggauguggugaggaugcggug

SEQ ID NO: 3180 - RNA, 21 nt, Artificial sequence
  specific aptamers
ggauguggugaggauguggag

SEQ ID NO: 3181 - RNA, 21 nt, Artificial sequence
  specific aptamers
ggauguggugaggauguggcg

SEQ ID NO: 3182 - RNA, 21 nt, Artificial sequence
  specific aptamers
ggauguggugaggauguggug

SEQ ID NO: 3183 - RNA, 20 nt, Artificial sequence
  specific aptamers
ggauguggugaggagaggag

SEQ ID NO: 3184 - RNA, 20 nt, Artificial sequence
  specific aptamers
ggauguggugaggagaggcg

SEQ ID NO: 3185 - RNA, 20 nt, Artificial sequence
  specific aptamers
ggauguggugaggagaggug

SEQ ID NO: 3186 - RNA, 20 nt, Artificial sequence
  specific aptamers
ggauguggugaggagcggag

SEQ ID NO: 3187 - RNA, 20 nt, Artificial sequence
  specific aptamers
ggauguggugaggagcggcg

SEQ ID NO: 3188 - RNA, 20 nt, Artificial sequence
  specific aptamers
ggauguggugaggagcggug

SEQ ID NO: 3189 - RNA, 20 nt, Artificial sequence
  specific aptamers
ggauguggugaggaguggag

SEQ ID NO: 3190 - RNA, 20 nt, Artificial sequence
  specific aptamers
ggauguggugaggaguggcg

SEQ ID NO: 3191 - RNA, 20 nt, Artificial sequence
  specific aptamers
ggauguggugaggaguggug

SEQ ID NO: 3192 - RNA, 21 nt, Artificial sequence
  specific aptamers
ggauguggugagguagaggag

SEQ ID NO: 3193 - RNA, 21 nt, Artificial sequence
  specific aptamers
ggauguggugagguagaggcg

SEQ ID NO: 3194 - RNA, 21 nt, Artificial sequence
  specific aptamers
ggauguggugagguagaggug

SEQ ID NO: 3195 - RNA, 21 nt, Artificial sequence
  specific aptamers
ggauguggugagguagcggag

SEQ ID NO: 3196 - RNA, 21 nt, Artificial sequence
  specific aptamers
ggauguggugagguagcggcg

SEQ ID NO: 3197 - RNA, 21 nt, Artificial sequence
  specific aptamers
ggauguggugagguagcggug

SEQ ID NO: 3198 - RNA, 21 nt, Artificial sequence
  specific aptamers
ggauguggugagguaguggag

SEQ ID NO: 3199 - RNA, 21 nt, Artificial sequence
  specific aptamers
ggauguggugagguaguggcg

SEQ ID NO: 3200 - RNA, 21 nt, Artificial sequence
  specific aptamers
ggauguggugagguaguggug

SEQ ID NO: 3201 - RNA, 21 nt, Artificial sequence
  specific aptamers
ggauguggugagguugaggag

SEQ ID NO: 3202 - RNA, 21 nt, Artificial sequence
  specific aptamers
ggauguggugagguugaggcg

SEQ ID NO: 3203 - RNA, 21 nt, Artificial sequence
  specific aptamers
ggauguggugagguugaggug

SEQ ID NO: 3204 - RNA, 21 nt, Artificial sequence
  specific aptamers
ggauguggugagguugcggag

SEQ ID NO: 3205 - RNA, 21 nt, Artificial sequence
  specific aptamers
ggauguggugagguugcggcg

SEQ ID NO: 3206 - RNA, 21 nt, Artificial sequence
  specific aptamers
ggauguggugagguugcggug

SEQ ID NO: 3207 - RNA, 21 nt, Artificial sequence
  specific aptamers
ggauguggugagguuguggag

SEQ ID NO: 3208 - RNA, 21 nt, Artificial sequence
  specific aptamers
ggauguggugagguuguggcg

SEQ ID NO: 3209 - RNA, 21 nt, Artificial sequence
  specific aptamers
ggauguggugagguuguggug

SEQ ID NO: 3210 - RNA, 20 nt, Artificial sequence
  specific aptamers
ggauguggugaggugaggag

SEQ ID NO: 3211 - RNA, 20 nt, Artificial sequence
  specific aptamers
ggauguggugaggugaggcg

SEQ ID NO: 3212 - RNA, 20 nt, Artificial sequence
  specific aptamers
ggauguggugaggugaggug

SEQ ID NO: 3213 - RNA, 20 nt, Artificial sequence
  specific aptamers
ggauguggugaggugcggag

SEQ ID NO: 3214 - RNA, 20 nt, Artificial sequence
  specific aptamers
ggauguggugaggugcggcg

SEQ ID NO: 3215 - RNA, 20 nt, Artificial sequence
  specific aptamers
ggauguggugaggugcggug

SEQ ID NO: 3216 - RNA, 20 nt, Artificial sequence
  specific aptamers
ggauguggugagguguggag

SEQ ID NO: 3217 - RNA, 20 nt, Artificial sequence
  specific aptamers
ggauguggugagguguggcg

SEQ ID NO: 3218 - RNA, 20 nt, Artificial sequence
  specific aptamers
ggauguggugagguguggug

SEQ ID NO: 3219 - RNA, 21 nt, Artificial sequence
  specific aptamers
ggaugugguguggaagaggag

SEQ ID NO: 3220 - RNA, 21 nt, Artificial sequence
  specific aptamers
ggaugugguguggaagaggcg

SEQ ID NO: 3221 - RNA, 21 nt, Artificial sequence
  specific aptamers
ggaugugguguggaagaggug

SEQ ID NO: 3222 - RNA, 21 nt, Artificial sequence
  specific aptamers
ggaugugguguggaagcggag

SEQ ID NO: 3223 - RNA, 21 nt, Artificial sequence
  specific aptamers
ggaugugguguggaagcggcg

SEQ ID NO: 3224 - RNA, 21 nt, Artificial sequence
  specific aptamers
ggaugugguguggaagcggug

SEQ ID NO: 3225 - RNA, 21 nt, Artificial sequence
  specific aptamers
ggaugugguguggaaguggag

SEQ ID NO: 3226 - RNA, 21 nt, Artificial sequence
  specific aptamers
ggaugugguguggaaguggcg

SEQ ID NO: 3227 - RNA, 21 nt, Artificial sequence
  specific aptamers
ggaugugguguggaaguggug

SEQ ID NO: 3228 - RNA, 21 nt, Artificial sequence
  specific aptamers
ggaugugguguggaugaggag

SEQ ID NO: 3229 - RNA, 21 nt, Artificial sequence
  specific aptamers
ggaugugguguggaugaggcg

SEQ ID NO: 3230 - RNA, 21 nt, Artificial sequence
  specific aptamers
ggaugugguguggaugaggug

SEQ ID NO: 3231 - RNA, 21 nt, Artificial sequence
  specific aptamers
ggaugugguguggaugcggag

SEQ ID NO: 3232 - RNA, 21 nt, Artificial sequence
  specific aptamers
ggaugugguguggaugcggcg

SEQ ID NO: 3233 - RNA, 21 nt, Artificial sequence
  specific aptamers
ggaugugguguggaugcggug

SEQ ID NO: 3234 - RNA, 21 nt, Artificial sequence
  specific aptamers
ggaugugguguggauguggag

SEQ ID NO: 3235 - RNA, 21 nt, Artificial sequence
  specific aptamers
ggaugugguguggauguggcg

SEQ ID NO: 3236 - RNA, 21 nt, Artificial sequence
  specific aptamers
ggaugugguguggauguggug

SEQ ID NO: 3237 - RNA, 20 nt, Artificial sequence
  specific aptamers
ggaugugguguggagaggag

SEQ ID NO: 3238 - RNA, 20 nt, Artificial sequence
  specific aptamers
ggaugugguguggagaggcg

SEQ ID NO: 3239 - RNA, 20 nt, Artificial sequence
  specific aptamers
ggaugugguguggagaggug

SEQ ID NO: 3240 - RNA, 20 nt, Artificial sequence
  specific aptamers
ggaugugguguggagcggag

SEQ ID NO: 3241 - RNA, 20 nt, Artificial sequence
  specific aptamers
ggaugugguguggagcggcg

SEQ ID NO: 3242 - RNA, 20 nt, Artificial sequence
  specific aptamers
ggaugugguguggagcggug

SEQ ID NO: 3243 - RNA, 20 nt, Artificial sequence
  specific aptamers
ggaugugguguggaguggag

SEQ ID NO: 3244 - RNA, 20 nt, Artificial sequence
  specific aptamers
ggaugugguguggaguggcg

SEQ ID NO: 3245 - RNA, 20 nt, Artificial sequence
  specific aptamers
ggaugugguguggaguggug

SEQ ID NO: 3246 - RNA, 21 nt, Artificial sequence
  specific aptamers
ggauguggugugguagaggag

SEQ ID NO: 3247 - RNA, 21 nt, Artificial sequence
  specific aptamers
ggauguggugugguagaggcg

SEQ ID NO: 3248 - RNA, 21 nt, Artificial sequence
  specific aptamers
ggauguggugugguagaggug

SEQ ID NO: 3249 - RNA, 21 nt, Artificial sequence
  specific aptamers
ggauguggugugguagcggag

SEQ ID NO: 3250 - RNA, 21 nt, Artificial sequence
  specific aptamers
ggauguggugugguagcggcg

SEQ ID NO: 3251 - RNA, 21 nt, Artificial sequence
  specific aptamers
ggauguggugugguagcggug

SEQ ID NO: 3252 - RNA, 21 nt, Artificial sequence
  specific aptamers
ggauguggugugguaguggag

SEQ ID NO: 3253 - RNA, 21 nt, Artificial sequence
  specific aptamers
ggauguggugugguaguggcg

SEQ ID NO: 3254 - RNA, 21 nt, Artificial sequence
  specific aptamers
ggauguggugugguaguggug

SEQ ID NO: 3255 - RNA, 21 nt, Artificial sequence
  specific aptamers
ggauguggugugguugaggag

SEQ ID NO: 3256 - RNA, 21 nt, Artificial sequence
  specific aptamers
ggauguggugugguugaggcg

SEQ ID NO: 3257 - RNA, 21 nt, Artificial sequence
  specific aptamers
ggauguggugugguugaggug

SEQ ID NO: 3258 - RNA, 21 nt, Artificial sequence
  specific aptamers
ggauguggugugguugcggag

SEQ ID NO: 3259 - RNA, 21 nt, Artificial sequence
  specific aptamers
ggauguggugugguugcggcg

SEQ ID NO: 3260 - RNA, 21 nt, Artificial sequence
  specific aptamers
ggauguggugugguugcggug

SEQ ID NO: 3261 - RNA, 21 nt, Artificial sequence
  specific aptamers
ggauguggugugguuguggag

SEQ ID NO: 3262 - RNA, 21 nt, Artificial sequence
  specific aptamers
ggauguggugugguuguggcg

SEQ ID NO: 3263 - RNA, 21 nt, Artificial sequence
  specific aptamers
ggauguggugugguuguggug

SEQ ID NO: 3264 - RNA, 20 nt, Artificial sequence
  specific aptamers
ggaugugguguggugaggag

SEQ ID NO: 3265 - RNA, 20 nt, Artificial sequence
  specific aptamers
ggaugugguguggugaggcg

SEQ ID NO: 3266 - RNA, 20 nt, Artificial sequence
  specific aptamers
ggaugugguguggugaggug

SEQ ID NO: 3267 - RNA, 20 nt, Artificial sequence
  specific aptamers
ggaugugguguggugcggag

SEQ ID NO: 3268 - RNA, 20 nt, Artificial sequence
  specific aptamers
ggaugugguguggugcggcg

SEQ ID NO: 3269 - RNA, 20 nt, Artificial sequence
  specific aptamers
ggaugugguguggugcggug

SEQ ID NO: 3270 - RNA, 20 nt, Artificial sequence
  specific aptamers
ggauguggugugguguggag

SEQ ID NO: 3271 - RNA, 20 nt, Artificial sequence
  specific aptamers
ggauguggugugguguggcg

SEQ ID NO: 3272 - RNA, 20 nt, Artificial sequence
  specific aptamers
ggauguggugugguguggug

SEQ ID NO: 3273 - RNA, 21 nt, Artificial sequence
  specific aptamers
ggcagaggagaggaagaggag

SEQ ID NO: 3274 - RNA, 21 nt, Artificial sequence
  specific aptamers
ggcagaggagaggaagaggcg

SEQ ID NO: 3275 - RNA, 21 nt, Artificial sequence
  specific aptamers
ggcagaggagaggaagaggug

SEQ ID NO: 3276 - RNA, 21 nt, Artificial sequence
  specific aptamers
ggcagaggagaggaagcggag

SEQ ID NO: 3277 - RNA, 21 nt, Artificial sequence
  specific aptamers
ggcagaggagaggaagcggcg

SEQ ID NO: 3278 - RNA, 21 nt, Artificial sequence
  specific aptamers
ggcagaggagaggaagcggug

SEQ ID NO: 3279 - RNA, 21 nt, Artificial sequence
  specific aptamers
ggcagaggagaggaaguggag

SEQ ID NO: 3280 - RNA, 21 nt, Artificial sequence
  specific aptamers
ggcagaggagaggaaguggcg

SEQ ID NO: 3281 - RNA, 21 nt, Artificial sequence
  specific aptamers
ggcagaggagaggaaguggug

SEQ ID NO: 3282 - RNA, 21 nt, Artificial sequence
  specific aptamers
ggcagaggagaggaugaggag

SEQ ID NO: 3283 - RNA, 21 nt, Artificial sequence
  specific aptamers
ggcagaggagaggaugaggcg

SEQ ID NO: 3284 - RNA, 21 nt, Artificial sequence
  specific aptamers
ggcagaggagaggaugaggug

SEQ ID NO: 3285 - RNA, 21 nt, Artificial sequence
  specific aptamers
ggcagaggagaggaugcggag

SEQ ID NO: 3286 - RNA, 21 nt, Artificial sequence
  specific aptamers
ggcagaggagaggaugcggcg

SEQ ID NO: 3287 - RNA, 21 nt, Artificial sequence
  specific aptamers
ggcagaggagaggaugcggug

SEQ ID NO: 3288 - RNA, 21 nt, Artificial sequence
  specific aptamers
ggcagaggagaggauguggag

SEQ ID NO: 3289 - RNA, 21 nt, Artificial sequence
  specific aptamers
ggcagaggagaggauguggcg

SEQ ID NO: 3290 - RNA, 21 nt, Artificial sequence
  specific aptamers
ggcagaggagaggauguggug

SEQ ID NO: 3291 - RNA, 20 nt, Artificial sequence
  specific aptamers
ggcagaggagaggagaggag

SEQ ID NO: 3292 - RNA, 20 nt, Artificial sequence
  specific aptamers
ggcagaggagaggagaggcg

SEQ ID NO: 3293 - RNA, 20 nt, Artificial sequence
  specific aptamers
ggcagaggagaggagaggug

SEQ ID NO: 3294 - RNA, 20 nt, Artificial sequence
  specific aptamers
ggcagaggagaggagcggag

SEQ ID NO: 3295 - RNA, 20 nt, Artificial sequence
  specific aptamers
ggcagaggagaggagcggcg

SEQ ID NO: 3296 - RNA, 20 nt, Artificial sequence
  specific aptamers
ggcagaggagaggagcggug

SEQ ID NO: 3297 - RNA, 20 nt, Artificial sequence
  specific aptamers
ggcagaggagaggaguggag

SEQ ID NO: 3298 - RNA, 20 nt, Artificial sequence
  specific aptamers
ggcagaggagaggaguggcg

SEQ ID NO: 3299 - RNA, 20 nt, Artificial sequence
  specific aptamers
ggcagaggagaggaguggug

SEQ ID NO: 3300 - RNA, 21 nt, Artificial sequence
  specific aptamers
ggcagaggagagguagaggag

SEQ ID NO: 3301 - RNA, 21 nt, Artificial sequence
  specific aptamers
ggcagaggagagguagaggcg

SEQ ID NO: 3302 - RNA, 21 nt, Artificial sequence
  specific aptamers
ggcagaggagagguagaggug

SEQ ID NO: 3303 - RNA, 21 nt, Artificial sequence
  specific aptamers
ggcagaggagagguagcggag

SEQ ID NO: 3304 - RNA, 21 nt, Artificial sequence
  specific aptamers
ggcagaggagagguagcggcg

SEQ ID NO: 3305 - RNA, 21 nt, Artificial sequence
  specific aptamers
ggcagaggagagguagcggug

SEQ ID NO: 3306 - RNA, 21 nt, Artificial sequence
  specific aptamers
ggcagaggagagguaguggag

SEQ ID NO: 3307 - RNA, 21 nt, Artificial sequence
  specific aptamers
ggcagaggagagguaguggcg

SEQ ID NO: 3308 - RNA, 21 nt, Artificial sequence
  specific aptamers
ggcagaggagagguaguggug

SEQ ID NO: 3309 - RNA, 21 nt, Artificial sequence
  specific aptamers
ggcagaggagagguugaggag

SEQ ID NO: 3310 - RNA, 21 nt, Artificial sequence
  specific aptamers
ggcagaggagagguugaggcg

SEQ ID NO: 3311 - RNA, 21 nt, Artificial sequence
  specific aptamers
ggcagaggagagguugaggug

SEQ ID NO: 3312 - RNA, 21 nt, Artificial sequence
  specific aptamers
ggcagaggagagguugcggag

SEQ ID NO: 3313 - RNA, 21 nt, Artificial sequence
  specific aptamers
ggcagaggagagguugcggcg

SEQ ID NO: 3314 - RNA, 21 nt, Artificial sequence
  specific aptamers
ggcagaggagagguugcggug

SEQ ID NO: 3315 - RNA, 21 nt, Artificial sequence
  specific aptamers
ggcagaggagagguuguggag

SEQ ID NO: 3316 - RNA, 21 nt, Artificial sequence
  specific aptamers
ggcagaggagagguuguggcg

SEQ ID NO: 3317 - RNA, 21 nt, Artificial sequence
  specific aptamers
ggcagaggagagguuguggug

SEQ ID NO: 3318 - RNA, 20 nt, Artificial sequence
  specific aptamers
ggcagaggagaggugaggag

SEQ ID NO: 3319 - RNA, 20 nt, Artificial sequence
  specific aptamers
ggcagaggagaggugaggcg

SEQ ID NO: 3320 - RNA, 20 nt, Artificial sequence
  specific aptamers
ggcagaggagaggugaggug

SEQ ID NO: 3321 - RNA, 20 nt, Artificial sequence
  specific aptamers
ggcagaggagaggugcggag

SEQ ID NO: 3322 - RNA, 20 nt, Artificial sequence
  specific aptamers
ggcagaggagaggugcggcg

SEQ ID NO: 3323 - RNA, 20 nt, Artificial sequence
  specific aptamers
ggcagaggagaggugcggug

SEQ ID NO: 3324 - RNA, 20 nt, Artificial sequence
  specific aptamers
ggcagaggagagguguggag

SEQ ID NO: 3325 - RNA, 20 nt, Artificial sequence
  specific aptamers
ggcagaggagagguguggcg

SEQ ID NO: 3326 - RNA, 20 nt, Artificial sequence
  specific aptamers
ggcagaggagagguguggug

SEQ ID NO: 3327 - RNA, 21 nt, Artificial sequence
  specific aptamers
ggcagaggaguggaagaggag

SEQ ID NO: 3328 - RNA, 21 nt, Artificial sequence
  specific aptamers
ggcagaggaguggaagaggcg

SEQ ID NO: 3329 - RNA, 21 nt, Artificial sequence
  specific aptamers
ggcagaggaguggaagaggug

SEQ ID NO: 3330 - RNA, 21 nt, Artificial sequence
  specific aptamers
ggcagaggaguggaagcggag

SEQ ID NO: 3331 - RNA, 21 nt, Artificial sequence
  specific aptamers
ggcagaggaguggaagcggcg

SEQ ID NO: 3332 - RNA, 21 nt, Artificial sequence
  specific aptamers
ggcagaggaguggaagcggug

SEQ ID NO: 3333 - RNA, 21 nt, Artificial sequence
  specific aptamers
ggcagaggaguggaaguggag

SEQ ID NO: 3334 - RNA, 21 nt, Artificial sequence
  specific aptamers
ggcagaggaguggaaguggcg

SEQ ID NO: 3335 - RNA, 21 nt, Artificial sequence
  specific aptamers
ggcagaggaguggaaguggug

SEQ ID NO: 3336 - RNA, 21 nt, Artificial sequence
  specific aptamers
ggcagaggaguggaugaggag

SEQ ID NO: 3337 - RNA, 21 nt, Artificial sequence
  specific aptamers
ggcagaggaguggaugaggcg

SEQ ID NO: 3338 - RNA, 21 nt, Artificial sequence
  specific aptamers
ggcagaggaguggaugaggug

SEQ ID NO: 3339 - RNA, 21 nt, Artificial sequence
  specific aptamers
ggcagaggaguggaugcggag

SEQ ID NO: 3340 - RNA, 21 nt, Artificial sequence
  specific aptamers
ggcagaggaguggaugcggcg

SEQ ID NO: 3341 - RNA, 21 nt, Artificial sequence
  specific aptamers
ggcagaggaguggaugcggug

SEQ ID NO: 3342 - RNA, 21 nt, Artificial sequence
  specific aptamers
ggcagaggaguggauguggag

SEQ ID NO: 3343 - RNA, 21 nt, Artificial sequence
  specific aptamers
ggcagaggaguggauguggcg

SEQ ID NO: 3344 - RNA, 21 nt, Artificial sequence
  specific aptamers
ggcagaggaguggauguggug

SEQ ID NO: 3345 - RNA, 20 nt, Artificial sequence
  specific aptamers
ggcagaggaguggagaggag

SEQ ID NO: 3346 - RNA, 20 nt, Artificial sequence
  specific aptamers
ggcagaggaguggagaggcg

SEQ ID NO: 3347 - RNA, 20 nt, Artificial sequence
  specific aptamers
ggcagaggaguggagaggug

SEQ ID NO: 3348 - RNA, 20 nt, Artificial sequence
  specific aptamers
ggcagaggaguggagcggag

SEQ ID NO: 3349 - RNA, 20 nt, Artificial sequence
  specific aptamers
ggcagaggaguggagcggcg

SEQ ID NO: 3350 - RNA, 20 nt, Artificial sequence
  specific aptamers
ggcagaggaguggagcggug

SEQ ID NO: 3351 - RNA, 20 nt, Artificial sequence
  specific aptamers
ggcagaggaguggaguggag

SEQ ID NO: 3352 - RNA, 20 nt, Artificial sequence
  specific aptamers
ggcagaggaguggaguggcg

SEQ ID NO: 3353 - RNA, 20 nt, Artificial sequence
  specific aptamers
ggcagaggaguggaguggug

SEQ ID NO: 3354 - RNA, 21 nt, Artificial sequence
  specific aptamers
ggcagaggagugguagaggag

SEQ ID NO: 3355 - RNA, 21 nt, Artificial sequence
  specific aptamers
ggcagaggagugguagaggcg

SEQ ID NO: 3356 - RNA, 21 nt, Artificial sequence
  specific aptamers
ggcagaggagugguagaggug

SEQ ID NO: 3357 - RNA, 21 nt, Artificial sequence
  specific aptamers
ggcagaggagugguagcggag

SEQ ID NO: 3358 - RNA, 21 nt, Artificial sequence
  specific aptamers
ggcagaggagugguagcggcg

SEQ ID NO: 3359 - RNA, 21 nt, Artificial sequence
  specific aptamers
ggcagaggagugguagcggug

SEQ ID NO: 3360 - RNA, 21 nt, Artificial sequence
  specific aptamers
ggcagaggagugguaguggag

SEQ ID NO: 3361 - RNA, 21 nt, Artificial sequence
  specific aptamers
ggcagaggagugguaguggcg

SEQ ID NO: 3362 - RNA, 21 nt, Artificial sequence
  specific aptamers
ggcagaggagugguaguggug

SEQ ID NO: 3363 - RNA, 21 nt, Artificial sequence
  specific aptamers
ggcagaggagugguugaggag

SEQ ID NO: 3364 - RNA, 21 nt, Artificial sequence
  specific aptamers
ggcagaggagugguugaggcg

SEQ ID NO: 3365 - RNA, 21 nt, Artificial sequence
  specific aptamers
ggcagaggagugguugaggug

SEQ ID NO: 3366 - RNA, 21 nt, Artificial sequence
  specific aptamers
ggcagaggagugguugcggag

SEQ ID NO: 3367 - RNA, 21 nt, Artificial sequence
  specific aptamers
ggcagaggagugguugcggcg

SEQ ID NO: 3368 - RNA, 21 nt, Artificial sequence
  specific aptamers
ggcagaggagugguugcggug

SEQ ID NO: 3369 - RNA, 21 nt, Artificial sequence
  specific aptamers
ggcagaggagugguuguggag

SEQ ID NO: 3370 - RNA, 21 nt, Artificial sequence
  specific aptamers
ggcagaggagugguuguggcg

SEQ ID NO: 3371 - RNA, 21 nt, Artificial sequence
  specific aptamers
ggcagaggagugguuguggug

SEQ ID NO: 3372 - RNA, 20 nt, Artificial sequence
  specific aptamers
ggcagaggaguggugaggag

SEQ ID NO: 3373 - RNA, 20 nt, Artificial sequence
  specific aptamers
ggcagaggaguggugaggcg

SEQ ID NO: 3374 - RNA, 20 nt, Artificial sequence
  specific aptamers
ggcagaggaguggugaggug

SEQ ID NO: 3375 - RNA, 20 nt, Artificial sequence
  specific aptamers
ggcagaggaguggugcggag

SEQ ID NO: 3376 - RNA, 20 nt, Artificial sequence
  specific aptamers
ggcagaggaguggugcggcg

SEQ ID NO: 3377 - RNA, 20 nt, Artificial sequence
  specific aptamers
ggcagaggaguggugcggug

SEQ ID NO: 3378 - RNA, 20 nt, Artificial sequence
  specific aptamers
ggcagaggagugguguggag

SEQ ID NO: 3379 - RNA, 20 nt, Artificial sequence
  specific aptamers
ggcagaggagugguguggcg

SEQ ID NO: 3380 - RNA, 20 nt, Artificial sequence
  specific aptamers
ggcagaggagugguguggug

SEQ ID NO: 3381 - RNA, 21 nt, Artificial sequence
  specific aptamers
ggcagaggugaggaagaggag

SEQ ID NO: 3382 - RNA, 21 nt, Artificial sequence
  specific aptamers
ggcagaggugaggaagaggcg

SEQ ID NO: 3383 - RNA, 21 nt, Artificial sequence
  specific aptamers
ggcagaggugaggaagaggug

SEQ ID NO: 3384 - RNA, 21 nt, Artificial sequence
  specific aptamers
ggcagaggugaggaagcggag

SEQ ID NO: 3385 - RNA, 21 nt, Artificial sequence
  specific aptamers
ggcagaggugaggaagcggcg

SEQ ID NO: 3386 - RNA, 21 nt, Artificial sequence
  specific aptamers
ggcagaggugaggaagcggug

SEQ ID NO: 3387 - RNA, 21 nt, Artificial sequence
  specific aptamers
ggcagaggugaggaaguggag

SEQ ID NO: 3388 - RNA, 21 nt, Artificial sequence
  specific aptamers
ggcagaggugaggaaguggcg

SEQ ID NO: 3389 - RNA, 21 nt, Artificial sequence
  specific aptamers
ggcagaggugaggaaguggug

SEQ ID NO: 3390 - RNA, 21 nt, Artificial sequence
  specific aptamers
ggcagaggugaggaugaggag

SEQ ID NO: 3391 - RNA, 21 nt, Artificial sequence
  specific aptamers
ggcagaggugaggaugaggcg

SEQ ID NO: 3392 - RNA, 21 nt, Artificial sequence
  specific aptamers
ggcagaggugaggaugaggug

SEQ ID NO: 3393 - RNA, 21 nt, Artificial sequence
  specific aptamers
ggcagaggugaggaugcggag

SEQ ID NO: 3394 - RNA, 21 nt, Artificial sequence
  specific aptamers
ggcagaggugaggaugcggcg

SEQ ID NO: 3395 - RNA, 21 nt, Artificial sequence
  specific aptamers
ggcagaggugaggaugcggug

SEQ ID NO: 3396 - RNA, 21 nt, Artificial sequence
  specific aptamers
ggcagaggugaggauguggag

SEQ ID NO: 3397 - RNA, 21 nt, Artificial sequence
  specific aptamers
ggcagaggugaggauguggcg

SEQ ID NO: 3398 - RNA, 21 nt, Artificial sequence
  specific aptamers
ggcagaggugaggauguggug

SEQ ID NO: 3399 - RNA, 20 nt, Artificial sequence
  specific aptamers
ggcagaggugaggagaggag

SEQ ID NO: 3400 - RNA, 20 nt, Artificial sequence
  specific aptamers
ggcagaggugaggagaggcg

SEQ ID NO: 3401 - RNA, 20 nt, Artificial sequence
  specific aptamers
ggcagaggugaggagaggug

SEQ ID NO: 3402 - RNA, 20 nt, Artificial sequence
  specific aptamers
ggcagaggugaggagcggag

SEQ ID NO: 3403 - RNA, 20 nt, Artificial sequence
  specific aptamers
ggcagaggugaggagcggcg

SEQ ID NO: 3404 - RNA, 20 nt, Artificial sequence
  specific aptamers
ggcagaggugaggagcggug

SEQ ID NO: 3405 - RNA, 20 nt, Artificial sequence
  specific aptamers
ggcagaggugaggaguggag

SEQ ID NO: 3406 - RNA, 20 nt, Artificial sequence
  specific aptamers
ggcagaggugaggaguggcg

SEQ ID NO: 3407 - RNA, 20 nt, Artificial sequence
  specific aptamers
ggcagaggugaggaguggug

SEQ ID NO: 3408 - RNA, 21 nt, Artificial sequence
  specific aptamers
ggcagaggugagguagaggag

SEQ ID NO: 3409 - RNA, 21 nt, Artificial sequence
  specific aptamers
ggcagaggugagguagaggcg

SEQ ID NO: 3410 - RNA, 21 nt, Artificial sequence
  specific aptamers
ggcagaggugagguagaggug

SEQ ID NO: 3411 - RNA, 21 nt, Artificial sequence
  specific aptamers
ggcagaggugagguagcggag

SEQ ID NO: 3412 - RNA, 21 nt, Artificial sequence
  specific aptamers
ggcagaggugagguagcggcg

SEQ ID NO: 3413 - RNA, 21 nt, Artificial sequence
  specific aptamers
ggcagaggugagguagcggug

SEQ ID NO: 3414 - RNA, 21 nt, Artificial sequence
  specific aptamers
ggcagaggugagguaguggag

SEQ ID NO: 3415 - RNA, 21 nt, Artificial sequence
  specific aptamers
ggcagaggugagguaguggcg

SEQ ID NO: 3416 - RNA, 21 nt, Artificial sequence
  specific aptamers
ggcagaggugagguaguggug

SEQ ID NO: 3417 - RNA, 21 nt, Artificial sequence
  specific aptamers
ggcagaggugagguugaggag

SEQ ID NO: 3418 - RNA, 21 nt, Artificial sequence
  specific aptamers
ggcagaggugagguugaggcg

SEQ ID NO: 3419 - RNA, 21 nt, Artificial sequence
  specific aptamers
ggcagaggugagguugaggug

SEQ ID NO: 3420 - RNA, 21 nt, Artificial sequence
  specific aptamers
ggcagaggugagguugcggag

SEQ ID NO: 3421 - RNA, 21 nt, Artificial sequence
  specific aptamers
ggcagaggugagguugcggcg

SEQ ID NO: 3422 - RNA, 21 nt, Artificial sequence
  specific aptamers
ggcagaggugagguugcggug

SEQ ID NO: 3423 - RNA, 21 nt, Artificial sequence
  specific aptamers
ggcagaggugagguuguggag

SEQ ID NO: 3424 - RNA, 21 nt, Artificial sequence
  specific aptamers
ggcagaggugagguuguggcg

SEQ ID NO: 3425 - RNA, 21 nt, Artificial sequence
  specific aptamers
ggcagaggugagguuguggug

SEQ ID NO: 3426 - RNA, 20 nt, Artificial sequence
  specific aptamers
ggcagaggugaggugaggag

SEQ ID NO: 3427 - RNA, 20 nt, Artificial sequence
  specific aptamers
ggcagaggugaggugaggcg

SEQ ID NO: 3428 - RNA, 20 nt, Artificial sequence
  specific aptamers
ggcagaggugaggugaggug

SEQ ID NO: 3429 - RNA, 20 nt, Artificial sequence
  specific aptamers
ggcagaggugaggugcggag

SEQ ID NO: 3430 - RNA, 20 nt, Artificial sequence
  specific aptamers
ggcagaggugaggugcggcg

SEQ ID NO: 3431 - RNA, 20 nt, Artificial sequence
  specific aptamers
ggcagaggugaggugcggug

SEQ ID NO: 3432 - RNA, 20 nt, Artificial sequence
  specific aptamers
ggcagaggugagguguggag

SEQ ID NO: 3433 - RNA, 20 nt, Artificial sequence
  specific aptamers
ggcagaggugagguguggcg

SEQ ID NO: 3434 - RNA, 20 nt, Artificial sequence
  specific aptamers
ggcagaggugagguguggug

SEQ ID NO: 3435 - RNA, 21 nt, Artificial sequence
  specific aptamers
ggcagagguguggaagaggag

SEQ ID NO: 3436 - RNA, 21 nt, Artificial sequence
  specific aptamers
ggcagagguguggaagaggcg

SEQ ID NO: 3437 - RNA, 21 nt, Artificial sequence
  specific aptamers
ggcagagguguggaagaggug

SEQ ID NO: 3438 - RNA, 21 nt, Artificial sequence
  specific aptamers
ggcagagguguggaagcggag

SEQ ID NO: 3439 - RNA, 21 nt, Artificial sequence
  specific aptamers
ggcagagguguggaagcggcg

SEQ ID NO: 3440 - RNA, 21 nt, Artificial sequence
  specific aptamers
ggcagagguguggaagcggug

SEQ ID NO: 3441 - RNA, 21 nt, Artificial sequence
  specific aptamers
ggcagagguguggaaguggag

SEQ ID NO: 3442 - RNA, 21 nt, Artificial sequence
  specific aptamers
ggcagagguguggaaguggcg

SEQ ID NO: 3443 - RNA, 21 nt, Artificial sequence
  specific aptamers
ggcagagguguggaaguggug

SEQ ID NO: 3444 - RNA, 21 nt, Artificial sequence
  specific aptamers
ggcagagguguggaugaggag

SEQ ID NO: 3445 - RNA, 21 nt, Artificial sequence
  specific aptamers
ggcagagguguggaugaggcg

SEQ ID NO: 3446 - RNA, 21 nt, Artificial sequence
  specific aptamers
ggcagagguguggaugaggug

SEQ ID NO: 3447 - RNA, 21 nt, Artificial sequence
  specific aptamers
ggcagagguguggaugcggag

SEQ ID NO: 3448 - RNA, 21 nt, Artificial sequence
  specific aptamers
ggcagagguguggaugcggcg

SEQ ID NO: 3449 - RNA, 21 nt, Artificial sequence
  specific aptamers
ggcagagguguggaugcggug

SEQ ID NO: 3450 - RNA, 21 nt, Artificial sequence
  specific aptamers
ggcagagguguggauguggag

SEQ ID NO: 3451 - RNA, 21 nt, Artificial sequence
  specific aptamers
ggcagagguguggauguggcg

SEQ ID NO: 3452 - RNA, 21 nt, Artificial sequence
  specific aptamers
ggcagagguguggauguggug

SEQ ID NO: 3453 - RNA, 20 nt, Artificial sequence
  specific aptamers
ggcagagguguggagaggag

SEQ ID NO: 3454 - RNA, 20 nt, Artificial sequence
  specific aptamers
ggcagagguguggagaggcg

SEQ ID NO: 3455 - RNA, 20 nt, Artificial sequence
  specific aptamers
ggcagagguguggagaggug

SEQ ID NO: 3456 - RNA, 20 nt, Artificial sequence
  specific aptamers
ggcagagguguggagcggag

SEQ ID NO: 3457 - RNA, 20 nt, Artificial sequence
  specific aptamers
ggcagagguguggagcggcg

SEQ ID NO: 3458 - RNA, 20 nt, Artificial sequence
  specific aptamers
ggcagagguguggagcggug

SEQ ID NO: 3459 - RNA, 20 nt, Artificial sequence
  specific aptamers
ggcagagguguggaguggag

SEQ ID NO: 3460 - RNA, 20 nt, Artificial sequence
  specific aptamers
ggcagagguguggaguggcg

SEQ ID NO: 3461 - RNA, 20 nt, Artificial sequence
  specific aptamers
ggcagagguguggaguggug

SEQ ID NO: 3462 - RNA, 21 nt, Artificial sequence
  specific aptamers
ggcagaggugugguagaggag

SEQ ID NO: 3463 - RNA, 21 nt, Artificial sequence
  specific aptamers
ggcagaggugugguagaggcg

SEQ ID NO: 3464 - RNA, 21 nt, Artificial sequence
  specific aptamers
ggcagaggugugguagaggug

SEQ ID NO: 3465 - RNA, 21 nt, Artificial sequence
  specific aptamers
ggcagaggugugguagcggag

SEQ ID NO: 3466 - RNA, 21 nt, Artificial sequence
  specific aptamers
ggcagaggugugguagcggcg

SEQ ID NO: 3467 - RNA, 21 nt, Artificial sequence
  specific aptamers
ggcagaggugugguagcggug

SEQ ID NO: 3468 - RNA, 21 nt, Artificial sequence
  specific aptamers
ggcagaggugugguaguggag

SEQ ID NO: 3469 - RNA, 21 nt, Artificial sequence
  specific aptamers
ggcagaggugugguaguggcg

SEQ ID NO: 3470 - RNA, 21 nt, Artificial sequence
  specific aptamers
ggcagaggugugguaguggug

SEQ ID NO: 3471 - RNA, 21 nt, Artificial sequence
  specific aptamers
ggcagaggugugguugaggag

SEQ ID NO: 3472 - RNA, 21 nt, Artificial sequence
  specific aptamers
ggcagaggugugguugaggcg

SEQ ID NO: 3473 - RNA, 21 nt, Artificial sequence
  specific aptamers
ggcagaggugugguugaggug

SEQ ID NO: 3474 - RNA, 21 nt, Artificial sequence
  specific aptamers
ggcagaggugugguugcggag

SEQ ID NO: 3475 - RNA, 21 nt, Artificial sequence
  specific aptamers
ggcagaggugugguugcggcg

SEQ ID NO: 3476 - RNA, 21 nt, Artificial sequence
  specific aptamers
ggcagaggugugguugcggug

SEQ ID NO: 3477 - RNA, 21 nt, Artificial sequence
  specific aptamers
ggcagaggugugguuguggag

SEQ ID NO: 3478 - RNA, 21 nt, Artificial sequence
  specific aptamers
ggcagaggugugguuguggcg

SEQ ID NO: 3479 - RNA, 21 nt, Artificial sequence
  specific aptamers
ggcagaggugugguuguggug

SEQ ID NO: 3480 - RNA, 20 nt, Artificial sequence
  specific aptamers
ggcagagguguggugaggag

SEQ ID NO: 3481 - RNA, 20 nt, Artificial sequence
  specific aptamers
ggcagagguguggugaggcg

SEQ ID NO: 3482 - RNA, 20 nt, Artificial sequence
  specific aptamers
ggcagagguguggugaggug

SEQ ID NO: 3483 - RNA, 20 nt, Artificial sequence
  specific aptamers
ggcagagguguggugcggag

SEQ ID NO: 3484 - RNA, 20 nt, Artificial sequence
  specific aptamers
ggcagagguguggugcggcg

SEQ ID NO: 3485 - RNA, 20 nt, Artificial sequence
  specific aptamers
ggcagagguguggugcggug

SEQ ID NO: 3486 - RNA, 20 nt, Artificial sequence
  specific aptamers
ggcagaggugugguguggag

SEQ ID NO: 3487 - RNA, 20 nt, Artificial sequence
  specific aptamers
ggcagaggugugguguggcg

SEQ ID NO: 3488 - RNA, 20 nt, Artificial sequence
  specific aptamers
ggcagaggugugguguggug

SEQ ID NO: 3489 - RNA, 21 nt, Artificial sequence
  specific aptamers
ggcaguggagaggaagaggag

SEQ ID NO: 3490 - RNA, 21 nt, Artificial sequence
  specific aptamers
ggcaguggagaggaagaggcg

SEQ ID NO: 3491 - RNA, 21 nt, Artificial sequence
  specific aptamers
ggcaguggagaggaagaggug

SEQ ID NO: 3492 - RNA, 21 nt, Artificial sequence
  specific aptamers
ggcaguggagaggaagcggag

SEQ ID NO: 3493 - RNA, 21 nt, Artificial sequence
  specific aptamers
ggcaguggagaggaagcggcg

SEQ ID NO: 3494 - RNA, 21 nt, Artificial sequence
  specific aptamers
ggcaguggagaggaagcggug

SEQ ID NO: 3495 - RNA, 21 nt, Artificial sequence
  specific aptamers
ggcaguggagaggaaguggag

SEQ ID NO: 3496 - RNA, 21 nt, Artificial sequence
  specific aptamers
ggcaguggagaggaaguggcg

SEQ ID NO: 3497 - RNA, 21 nt, Artificial sequence
  specific aptamers
ggcaguggagaggaaguggug

SEQ ID NO: 3498 - RNA, 21 nt, Artificial sequence
  specific aptamers
ggcaguggagaggaugaggag

SEQ ID NO: 3499 - RNA, 21 nt, Artificial sequence
  specific aptamers
ggcaguggagaggaugaggcg

SEQ ID NO: 3500 - RNA, 21 nt, Artificial sequence
  specific aptamers
ggcaguggagaggaugaggug

SEQ ID NO: 3501 - RNA, 21 nt, Artificial sequence
  specific aptamers
ggcaguggagaggaugcggag

SEQ ID NO: 3502 - RNA, 21 nt, Artificial sequence
  specific aptamers
ggcaguggagaggaugcggcg

SEQ ID NO: 3503 - RNA, 21 nt, Artificial sequence
  specific aptamers
ggcaguggagaggaugcggug

SEQ ID NO: 3504 - RNA, 21 nt, Artificial sequence
  specific aptamers
ggcaguggagaggauguggag

SEQ ID NO: 3505 - RNA, 21 nt, Artificial sequence
  specific aptamers
ggcaguggagaggauguggcg

SEQ ID NO: 3506 - RNA, 21 nt, Artificial sequence
  specific aptamers
ggcaguggagaggauguggug

SEQ ID NO: 3507 - RNA, 20 nt, Artificial sequence
  specific aptamers
ggcaguggagaggagaggag

SEQ ID NO: 3508 - RNA, 20 nt, Artificial sequence
  specific aptamers
ggcaguggagaggagaggcg

SEQ ID NO: 3509 - RNA, 20 nt, Artificial sequence
  specific aptamers
ggcaguggagaggagaggug

SEQ ID NO: 3510 - RNA, 20 nt, Artificial sequence
  specific aptamers
ggcaguggagaggagcggag

SEQ ID NO: 3511 - RNA, 20 nt, Artificial sequence
  specific aptamers
ggcaguggagaggagcggcg

SEQ ID NO: 3512 - RNA, 20 nt, Artificial sequence
  specific aptamers
ggcaguggagaggagcggug

SEQ ID NO: 3513 - RNA, 20 nt, Artificial sequence
  specific aptamers
ggcaguggagaggaguggag

SEQ ID NO: 3514 - RNA, 20 nt, Artificial sequence
  specific aptamers
ggcaguggagaggaguggcg

SEQ ID NO: 3515 - RNA, 20 nt, Artificial sequence
  specific aptamers
ggcaguggagaggaguggug

SEQ ID NO: 3516 - RNA, 21 nt, Artificial sequence
  specific aptamers
ggcaguggagagguagaggag

SEQ ID NO: 3517 - RNA, 21 nt, Artificial sequence
  specific aptamers
ggcaguggagagguagaggcg

SEQ ID NO: 3518 - RNA, 21 nt, Artificial sequence
  specific aptamers
ggcaguggagagguagaggug

SEQ ID NO: 3519 - RNA, 21 nt, Artificial sequence
  specific aptamers
ggcaguggagagguagcggag

SEQ ID NO: 3520 - RNA, 21 nt, Artificial sequence
  specific aptamers
ggcaguggagagguagcggcg

SEQ ID NO: 3521 - RNA, 21 nt, Artificial sequence
  specific aptamers
ggcaguggagagguagcggug

SEQ ID NO: 3522 - RNA, 21 nt, Artificial sequence
  specific aptamers
ggcaguggagagguaguggag

SEQ ID NO: 3523 - RNA, 21 nt, Artificial sequence
  specific aptamers
ggcaguggagagguaguggcg

SEQ ID NO: 3524 - RNA, 21 nt, Artificial sequence
  specific aptamers
ggcaguggagagguaguggug

SEQ ID NO: 3525 - RNA, 21 nt, Artificial sequence
  specific aptamers
ggcaguggagagguugaggag

SEQ ID NO: 3526 - RNA, 21 nt, Artificial sequence
  specific aptamers
ggcaguggagagguugaggcg

SEQ ID NO: 3527 - RNA, 21 nt, Artificial sequence
  specific aptamers
ggcaguggagagguugaggug

SEQ ID NO: 3528 - RNA, 21 nt, Artificial sequence
  specific aptamers
ggcaguggagagguugcggag

SEQ ID NO: 3529 - RNA, 21 nt, Artificial sequence
  specific aptamers
ggcaguggagagguugcggcg

SEQ ID NO: 3530 - RNA, 21 nt, Artificial sequence
  specific aptamers
ggcaguggagagguugcggug

SEQ ID NO: 3531 - RNA, 21 nt, Artificial sequence
  specific aptamers
ggcaguggagagguuguggag

SEQ ID NO: 3532 - RNA, 21 nt, Artificial sequence
  specific aptamers
ggcaguggagagguuguggcg

SEQ ID NO: 3533 - RNA, 21 nt, Artificial sequence
  specific aptamers
ggcaguggagagguuguggug

SEQ ID NO: 3534 - RNA, 20 nt, Artificial sequence
  specific aptamers
ggcaguggagaggugaggag

SEQ ID NO: 3535 - RNA, 20 nt, Artificial sequence
  specific aptamers
ggcaguggagaggugaggcg

SEQ ID NO: 3536 - RNA, 20 nt, Artificial sequence
  specific aptamers
ggcaguggagaggugaggug

SEQ ID NO: 3537 - RNA, 20 nt, Artificial sequence
  specific aptamers
ggcaguggagaggugcggag

SEQ ID NO: 3538 - RNA, 20 nt, Artificial sequence
  specific aptamers
ggcaguggagaggugcggcg

SEQ ID NO: 3539 - RNA, 20 nt, Artificial sequence
  specific aptamers
ggcaguggagaggugcggug

SEQ ID NO: 3540 - RNA, 20 nt, Artificial sequence
  specific aptamers
ggcaguggagagguguggag

SEQ ID NO: 3541 - RNA, 20 nt, Artificial sequence
  specific aptamers
ggcaguggagagguguggcg

SEQ ID NO: 3542 - RNA, 20 nt, Artificial sequence
  specific aptamers
ggcaguggagagguguggug

SEQ ID NO: 3543 - RNA, 21 nt, Artificial sequence
  specific aptamers
ggcaguggaguggaagaggag

SEQ ID NO: 3544 - RNA, 21 nt, Artificial sequence
  specific aptamers
ggcaguggaguggaagaggcg

SEQ ID NO: 3545 - RNA, 21 nt, Artificial sequence
  specific aptamers
ggcaguggaguggaagaggug

SEQ ID NO: 3546 - RNA, 21 nt, Artificial sequence
  specific aptamers
ggcaguggaguggaagcggag

SEQ ID NO: 3547 - RNA, 21 nt, Artificial sequence
  specific aptamers
ggcaguggaguggaagcggcg

SEQ ID NO: 3548 - RNA, 21 nt, Artificial sequence
  specific aptamers
ggcaguggaguggaagcggug

SEQ ID NO: 3549 - RNA, 21 nt, Artificial sequence
  specific aptamers
ggcaguggaguggaaguggag

SEQ ID NO: 3550 - RNA, 21 nt, Artificial sequence
  specific aptamers
ggcaguggaguggaaguggcg

SEQ ID NO: 3551 - RNA, 21 nt, Artificial sequence
  specific aptamers
ggcaguggaguggaaguggug

SEQ ID NO: 3552 - RNA, 21 nt, Artificial sequence
  specific aptamers
ggcaguggaguggaugaggag

SEQ ID NO: 3553 - RNA, 21 nt, Artificial sequence
  specific aptamers
ggcaguggaguggaugaggcg

SEQ ID NO: 3554 - RNA, 21 nt, Artificial sequence
  specific aptamers
ggcaguggaguggaugaggug

SEQ ID NO: 3555 - RNA, 21 nt, Artificial sequence
  specific aptamers
ggcaguggaguggaugcggag

SEQ ID NO: 3556 - RNA, 21 nt, Artificial sequence
  specific aptamers
ggcaguggaguggaugcggcg

SEQ ID NO: 3557 - RNA, 21 nt, Artificial sequence
  specific aptamers
ggcaguggaguggaugcggug

SEQ ID NO: 3558 - RNA, 21 nt, Artificial sequence
  specific aptamers
ggcaguggaguggauguggag

SEQ ID NO: 3559 - RNA, 21 nt, Artificial sequence
  specific aptamers
ggcaguggaguggauguggcg

SEQ ID NO: 3560 - RNA, 21 nt, Artificial sequence
  specific aptamers
ggcaguggaguggauguggug

SEQ ID NO: 3561 - RNA, 20 nt, Artificial sequence
  specific aptamers
ggcaguggaguggagaggag

SEQ ID NO: 3562 - RNA, 20 nt, Artificial sequence
  specific aptamers
ggcaguggaguggagaggcg

SEQ ID NO: 3563 - RNA, 20 nt, Artificial sequence
  specific aptamers
ggcaguggaguggagaggug

SEQ ID NO: 3564 - RNA, 20 nt, Artificial sequence
  specific aptamers
ggcaguggaguggagcggag

SEQ ID NO: 3565 - RNA, 20 nt, Artificial sequence
  specific aptamers
ggcaguggaguggagcggcg

SEQ ID NO: 3566 - RNA, 20 nt, Artificial sequence
  specific aptamers
ggcaguggaguggagcggug

SEQ ID NO: 3567 - RNA, 20 nt, Artificial sequence
  specific aptamers
ggcaguggaguggaguggag

SEQ ID NO: 3568 - RNA, 20 nt, Artificial sequence
  specific aptamers
ggcaguggaguggaguggcg

SEQ ID NO: 3569 - RNA, 20 nt, Artificial sequence
  specific aptamers
ggcaguggaguggaguggug

SEQ ID NO: 3570 - RNA, 21 nt, Artificial sequence
  specific aptamers
ggcaguggagugguagaggag

SEQ ID NO: 3571 - RNA, 21 nt, Artificial sequence
  specific aptamers
ggcaguggagugguagaggcg

SEQ ID NO: 3572 - RNA, 21 nt, Artificial sequence
  specific aptamers
ggcaguggagugguagaggug

SEQ ID NO: 3573 - RNA, 21 nt, Artificial sequence
  specific aptamers
ggcaguggagugguagcggag

SEQ ID NO: 3574 - RNA, 21 nt, Artificial sequence
  specific aptamers
ggcaguggagugguagcggcg

SEQ ID NO: 3575 - RNA, 21 nt, Artificial sequence
  specific aptamers
ggcaguggagugguagcggug

SEQ ID NO: 3576 - RNA, 21 nt, Artificial sequence
  specific aptamers
ggcaguggagugguaguggag

SEQ ID NO: 3577 - RNA, 21 nt, Artificial sequence
  specific aptamers
ggcaguggagugguaguggcg

SEQ ID NO: 3578 - RNA, 21 nt, Artificial sequence
  specific aptamers
ggcaguggagugguaguggug

SEQ ID NO: 3579 - RNA, 21 nt, Artificial sequence
  specific aptamers
ggcaguggagugguugaggag

SEQ ID NO: 3580 - RNA, 21 nt, Artificial sequence
  specific aptamers
ggcaguggagugguugaggcg

SEQ ID NO: 3581 - RNA, 21 nt, Artificial sequence
  specific aptamers
ggcaguggagugguugaggug

SEQ ID NO: 3582 - RNA, 21 nt, Artificial sequence
  specific aptamers
ggcaguggagugguugcggag

SEQ ID NO: 3583 - RNA, 21 nt, Artificial sequence
  specific aptamers
ggcaguggagugguugcggcg

SEQ ID NO: 3584 - RNA, 21 nt, Artificial sequence
  specific aptamers
ggcaguggagugguugcggug

SEQ ID NO: 3585 - RNA, 21 nt, Artificial sequence
  specific aptamers
ggcaguggagugguuguggag

SEQ ID NO: 3586 - RNA, 21 nt, Artificial sequence
  specific aptamers
ggcaguggagugguuguggcg

SEQ ID NO: 3587 - RNA, 21 nt, Artificial sequence
  specific aptamers
ggcaguggagugguuguggug

SEQ ID NO: 3588 - RNA, 20 nt, Artificial sequence
  specific aptamers
ggcaguggaguggugaggag

SEQ ID NO: 3589 - RNA, 20 nt, Artificial sequence
  specific aptamers
ggcaguggaguggugaggcg

SEQ ID NO: 3590 - RNA, 20 nt, Artificial sequence
  specific aptamers
ggcaguggaguggugaggug

SEQ ID NO: 3591 - RNA, 20 nt, Artificial sequence
  specific aptamers
ggcaguggaguggugcggag

SEQ ID NO: 3592 - RNA, 20 nt, Artificial sequence
  specific aptamers
ggcaguggaguggugcggcg

SEQ ID NO: 3593 - RNA, 20 nt, Artificial sequence
  specific aptamers
ggcaguggaguggugcggug

SEQ ID NO: 3594 - RNA, 20 nt, Artificial sequence
  specific aptamers
ggcaguggagugguguggag

SEQ ID NO: 3595 - RNA, 20 nt, Artificial sequence
  specific aptamers
ggcaguggagugguguggcg

SEQ ID NO: 3596 - RNA, 20 nt, Artificial sequence
  specific aptamers
ggcaguggagugguguggug

SEQ ID NO: 3597 - RNA, 21 nt, Artificial sequence
  specific aptamers
ggcaguggugaggaagaggag

SEQ ID NO: 3598 - RNA, 21 nt, Artificial sequence
  specific aptamers
ggcaguggugaggaagaggcg

SEQ ID NO: 3599 - RNA, 21 nt, Artificial sequence
  specific aptamers
ggcaguggugaggaagaggug

SEQ ID NO: 3600 - RNA, 21 nt, Artificial sequence
  specific aptamers
ggcaguggugaggaagcggag

SEQ ID NO: 3601 - RNA, 21 nt, Artificial sequence
  specific aptamers
ggcaguggugaggaagcggcg

SEQ ID NO: 3602 - RNA, 21 nt, Artificial sequence
  specific aptamers
ggcaguggugaggaagcggug

SEQ ID NO: 3603 - RNA, 21 nt, Artificial sequence
  specific aptamers
ggcaguggugaggaaguggag

SEQ ID NO: 3604 - RNA, 21 nt, Artificial sequence
  specific aptamers
ggcaguggugaggaaguggcg

SEQ ID NO: 3605 - RNA, 21 nt, Artificial sequence
  specific aptamers
ggcaguggugaggaaguggug

SEQ ID NO: 3606 - RNA, 21 nt, Artificial sequence
  specific aptamers
ggcaguggugaggaugaggag

SEQ ID NO: 3607 - RNA, 21 nt, Artificial sequence
  specific aptamers
ggcaguggugaggaugaggcg

SEQ ID NO: 3608 - RNA, 21 nt, Artificial sequence
  specific aptamers
ggcaguggugaggaugaggug

SEQ ID NO: 3609 - RNA, 21 nt, Artificial sequence
  specific aptamers
ggcaguggugaggaugcggag

SEQ ID NO: 3610 - RNA, 21 nt, Artificial sequence
  specific aptamers
ggcaguggugaggaugcggcg

SEQ ID NO: 3611 - RNA, 21 nt, Artificial sequence
  specific aptamers
ggcaguggugaggaugcggug

SEQ ID NO: 3612 - RNA, 21 nt, Artificial sequence
  specific aptamers
ggcaguggugaggauguggag

SEQ ID NO: 3613 - RNA, 21 nt, Artificial sequence
  specific aptamers
ggcaguggugaggauguggcg

SEQ ID NO: 3614 - RNA, 21 nt, Artificial sequence
  specific aptamers
ggcaguggugaggauguggug

SEQ ID NO: 3615 - RNA, 20 nt, Artificial sequence
  specific aptamers
ggcaguggugaggagaggag

SEQ ID NO: 3616 - RNA, 20 nt, Artificial sequence
  specific aptamers
ggcaguggugaggagaggcg

SEQ ID NO: 3617 - RNA, 20 nt, Artificial sequence
  specific aptamers
ggcaguggugaggagaggug

SEQ ID NO: 3618 - RNA, 20 nt, Artificial sequence
  specific aptamers
ggcaguggugaggagcggag

SEQ ID NO: 3619 - RNA, 20 nt, Artificial sequence
  specific aptamers
ggcaguggugaggagcggcg

SEQ ID NO: 3620 - RNA, 20 nt, Artificial sequence
  specific aptamers
ggcaguggugaggagcggug

SEQ ID NO: 3621 - RNA, 20 nt, Artificial sequence
  specific aptamers
ggcaguggugaggaguggag

SEQ ID NO: 3622 - RNA, 20 nt, Artificial sequence
  specific aptamers
ggcaguggugaggaguggcg

SEQ ID NO: 3623 - RNA, 20 nt, Artificial sequence
  specific aptamers
ggcaguggugaggaguggug

SEQ ID NO: 3624 - RNA, 21 nt, Artificial sequence
  specific aptamers
ggcaguggugagguagaggag

SEQ ID NO: 3625 - RNA, 21 nt, Artificial sequence
  specific aptamers
ggcaguggugagguagaggcg

SEQ ID NO: 3626 - RNA, 21 nt, Artificial sequence
  specific aptamers
ggcaguggugagguagaggug

SEQ ID NO: 3627 - RNA, 21 nt, Artificial sequence
  specific aptamers
ggcaguggugagguagcggag

SEQ ID NO: 3628 - RNA, 21 nt, Artificial sequence
  specific aptamers
ggcaguggugagguagcggcg

SEQ ID NO: 3629 - RNA, 21 nt, Artificial sequence
  specific aptamers
ggcaguggugagguagcggug

SEQ ID NO: 3630 - RNA, 21 nt, Artificial sequence
  specific aptamers
ggcaguggugagguaguggag

SEQ ID NO: 3631 - RNA, 21 nt, Artificial sequence
  specific aptamers
ggcaguggugagguaguggcg

SEQ ID NO: 3632 - RNA, 21 nt, Artificial sequence
  specific aptamers
ggcaguggugagguaguggug

SEQ ID NO: 3633 - RNA, 21 nt, Artificial sequence
  specific aptamers
ggcaguggugagguugaggag

SEQ ID NO: 3634 - RNA, 21 nt, Artificial sequence
  specific aptamers
ggcaguggugagguugaggcg

SEQ ID NO: 3635 - RNA, 21 nt, Artificial sequence
  specific aptamers
ggcaguggugagguugaggug

SEQ ID NO: 3636 - RNA, 21 nt, Artificial sequence
  specific aptamers
ggcaguggugagguugcggag

SEQ ID NO: 3637 - RNA, 21 nt, Artificial sequence
  specific aptamers
ggcaguggugagguugcggcg

SEQ ID NO: 3638 - RNA, 21 nt, Artificial sequence
  specific aptamers
ggcaguggugagguugcggug

SEQ ID NO: 3639 - RNA, 21 nt, Artificial sequence
  specific aptamers
ggcaguggugagguuguggag

SEQ ID NO: 3640 - RNA, 21 nt, Artificial sequence
  specific aptamers
ggcaguggugagguuguggcg

SEQ ID NO: 3641 - RNA, 21 nt, Artificial sequence
  specific aptamers
ggcaguggugagguuguggug

SEQ ID NO: 3642 - RNA, 20 nt, Artificial sequence
  specific aptamers
ggcaguggugaggugaggag

SEQ ID NO: 3643 - RNA, 20 nt, Artificial sequence
  specific aptamers
ggcaguggugaggugaggcg

SEQ ID NO: 3644 - RNA, 20 nt, Artificial sequence
  specific aptamers
ggcaguggugaggugaggug

SEQ ID NO: 3645 - RNA, 20 nt, Artificial sequence
  specific aptamers
ggcaguggugaggugcggag

SEQ ID NO: 3646 - RNA, 20 nt, Artificial sequence
  specific aptamers
ggcaguggugaggugcggcg

SEQ ID NO: 3647 - RNA, 20 nt, Artificial sequence
  specific aptamers
ggcaguggugaggugcggug

SEQ ID NO: 3648 - RNA, 20 nt, Artificial sequence
  specific aptamers
ggcaguggugagguguggag

SEQ ID NO: 3649 - RNA, 20 nt, Artificial sequence
  specific aptamers
ggcaguggugagguguggcg

SEQ ID NO: 3650 - RNA, 20 nt, Artificial sequence
  specific aptamers
ggcaguggugagguguggug

SEQ ID NO: 3651 - RNA, 21 nt, Artificial sequence
  specific aptamers
ggcagugguguggaagaggag

SEQ ID NO: 3652 - RNA, 21 nt, Artificial sequence
  specific aptamers
ggcagugguguggaagaggcg

SEQ ID NO: 3653 - RNA, 21 nt, Artificial sequence
  specific aptamers
ggcagugguguggaagaggug

SEQ ID NO: 3654 - RNA, 21 nt, Artificial sequence
  specific aptamers
ggcagugguguggaagcggag

SEQ ID NO: 3655 - RNA, 21 nt, Artificial sequence
  specific aptamers
ggcagugguguggaagcggcg

SEQ ID NO: 3656 - RNA, 21 nt, Artificial sequence
  specific aptamers
ggcagugguguggaagcggug

SEQ ID NO: 3657 - RNA, 21 nt, Artificial sequence
  specific aptamers
ggcagugguguggaaguggag

SEQ ID NO: 3658 - RNA, 21 nt, Artificial sequence
  specific aptamers
ggcagugguguggaaguggcg

SEQ ID NO: 3659 - RNA, 21 nt, Artificial sequence
  specific aptamers
ggcagugguguggaaguggug

SEQ ID NO: 3660 - RNA, 21 nt, Artificial sequence
  specific aptamers
ggcagugguguggaugaggag

SEQ ID NO: 3661 - RNA, 21 nt, Artificial sequence
  specific aptamers
ggcagugguguggaugaggcg

SEQ ID NO: 3662 - RNA, 21 nt, Artificial sequence
  specific aptamers
ggcagugguguggaugaggug

SEQ ID NO: 3663 - RNA, 21 nt, Artificial sequence
  specific aptamers
ggcagugguguggaugcggag

SEQ ID NO: 3664 - RNA, 21 nt, Artificial sequence
  specific aptamers
ggcagugguguggaugcggcg

SEQ ID NO: 3665 - RNA, 21 nt, Artificial sequence
  specific aptamers
ggcagugguguggaugcggug

SEQ ID NO: 3666 - RNA, 21 nt, Artificial sequence
  specific aptamers
ggcagugguguggauguggag

SEQ ID NO: 3667 - RNA, 21 nt, Artificial sequence
  specific aptamers
ggcagugguguggauguggcg

SEQ ID NO: 3668 - RNA, 21 nt, Artificial sequence
  specific aptamers
ggcagugguguggauguggug

SEQ ID NO: 3669 - RNA, 20 nt, Artificial sequence
  specific aptamers
ggcagugguguggagaggag

SEQ ID NO: 3670 - RNA, 20 nt, Artificial sequence
  specific aptamers
ggcagugguguggagaggcg

SEQ ID NO: 3671 - RNA, 20 nt, Artificial sequence
  specific aptamers
ggcagugguguggagaggug

SEQ ID NO: 3672 - RNA, 20 nt, Artificial sequence
  specific aptamers
ggcagugguguggagcggag

SEQ ID NO: 3673 - RNA, 20 nt, Artificial sequence
  specific aptamers
ggcagugguguggagcggcg

SEQ ID NO: 3674 - RNA, 20 nt, Artificial sequence
  specific aptamers
ggcagugguguggagcggug

SEQ ID NO: 3675 - RNA, 20 nt, Artificial sequence
  specific aptamers
ggcagugguguggaguggag

SEQ ID NO: 3676 - RNA, 20 nt, Artificial sequence
  specific aptamers
ggcagugguguggaguggcg

SEQ ID NO: 3677 - RNA, 20 nt, Artificial sequence
  specific aptamers
ggcagugguguggaguggug

SEQ ID NO: 3678 - RNA, 21 nt, Artificial sequence
  specific aptamers
ggcaguggugugguagaggag

SEQ ID NO: 3679 - RNA, 21 nt, Artificial sequence
  specific aptamers
ggcaguggugugguagaggcg

SEQ ID NO: 3680 - RNA, 21 nt, Artificial sequence
  specific aptamers
ggcaguggugugguagaggug

SEQ ID NO: 3681 - RNA, 21 nt, Artificial sequence
  specific aptamers
ggcaguggugugguagcggag

SEQ ID NO: 3682 - RNA, 21 nt, Artificial sequence
  specific aptamers
ggcaguggugugguagcggcg

SEQ ID NO: 3683 - RNA, 21 nt, Artificial sequence
  specific aptamers
ggcaguggugugguagcggug

SEQ ID NO: 3684 - RNA, 21 nt, Artificial sequence
  specific aptamers
ggcaguggugugguaguggag

SEQ ID NO: 3685 - RNA, 21 nt, Artificial sequence
  specific aptamers
ggcaguggugugguaguggcg

SEQ ID NO: 3686 - RNA, 21 nt, Artificial sequence
  specific aptamers
ggcaguggugugguaguggug

SEQ ID NO: 3687 - RNA, 21 nt, Artificial sequence
  specific aptamers
ggcaguggugugguugaggag

SEQ ID NO: 3688 - RNA, 21 nt, Artificial sequence
  specific aptamers
ggcaguggugugguugaggcg

SEQ ID NO: 3689 - RNA, 21 nt, Artificial sequence
  specific aptamers
ggcaguggugugguugaggug

SEQ ID NO: 3690 - RNA, 21 nt, Artificial sequence
  specific aptamers
ggcaguggugugguugcggag

SEQ ID NO: 3691 - RNA, 21 nt, Artificial sequence
  specific aptamers
ggcaguggugugguugcggcg

SEQ ID NO: 3692 - RNA, 21 nt, Artificial sequence
  specific aptamers
ggcaguggugugguugcggug

SEQ ID NO: 3693 - RNA, 21 nt, Artificial sequence
  specific aptamers
ggcaguggugugguuguggag

SEQ ID NO: 3694 - RNA, 21 nt, Artificial sequence
  specific aptamers
ggcaguggugugguuguggcg

SEQ ID NO: 3695 - RNA, 21 nt, Artificial sequence
  specific aptamers
ggcaguggugugguuguggug

SEQ ID NO: 3696 - RNA, 20 nt, Artificial sequence
  specific aptamers
ggcagugguguggugaggag

SEQ ID NO: 3697 - RNA, 20 nt, Artificial sequence
  specific aptamers
ggcagugguguggugaggcg

SEQ ID NO: 3698 - RNA, 20 nt, Artificial sequence
  specific aptamers
ggcagugguguggugaggug

SEQ ID NO: 3699 - RNA, 20 nt, Artificial sequence
  specific aptamers
ggcagugguguggugcggag

SEQ ID NO: 3700 - RNA, 20 nt, Artificial sequence
  specific aptamers
ggcagugguguggugcggcg

SEQ ID NO: 3701 - RNA, 20 nt, Artificial sequence
  specific aptamers
ggcagugguguggugcggug

SEQ ID NO: 3702 - RNA, 20 nt, Artificial sequence
  specific aptamers
ggcaguggugugguguggag

SEQ ID NO: 3703 - RNA, 20 nt, Artificial sequence
  specific aptamers
ggcaguggugugguguggcg

SEQ ID NO: 3704 - RNA, 20 nt, Artificial sequence
  specific aptamers
ggcaguggugugguguggug

SEQ ID NO: 3705 - RNA, 21 nt, Artificial sequence
  specific aptamers
ggcugaggagaggaagaggag

SEQ ID NO: 3706 - RNA, 21 nt, Artificial sequence
  specific aptamers
ggcugaggagaggaagaggcg

SEQ ID NO: 3707 - RNA, 21 nt, Artificial sequence
  specific aptamers
ggcugaggagaggaagaggug

SEQ ID NO: 3708 - RNA, 21 nt, Artificial sequence
  specific aptamers
ggcugaggagaggaagcggag

SEQ ID NO: 3709 - RNA, 21 nt, Artificial sequence
  specific aptamers
ggcugaggagaggaagcggcg

SEQ ID NO: 3710 - RNA, 21 nt, Artificial sequence
  specific aptamers
ggcugaggagaggaagcggug

SEQ ID NO: 3711 - RNA, 21 nt, Artificial sequence
  specific aptamers
ggcugaggagaggaaguggag

SEQ ID NO: 3712 - RNA, 21 nt, Artificial sequence
  specific aptamers
ggcugaggagaggaaguggcg

SEQ ID NO: 3713 - RNA, 21 nt, Artificial sequence
  specific aptamers
ggcugaggagaggaaguggug

SEQ ID NO: 3714 - RNA, 21 nt, Artificial sequence
  specific aptamers
ggcugaggagaggaugaggag

SEQ ID NO: 3715 - RNA, 21 nt, Artificial sequence
  specific aptamers
ggcugaggagaggaugaggcg

SEQ ID NO: 3716 - RNA, 21 nt, Artificial sequence
  specific aptamers
ggcugaggagaggaugaggug

SEQ ID NO: 3717 - RNA, 21 nt, Artificial sequence
  specific aptamers
ggcugaggagaggaugcggag

SEQ ID NO: 3718 - RNA, 21 nt, Artificial sequence
  specific aptamers
ggcugaggagaggaugcggcg

SEQ ID NO: 3719 - RNA, 21 nt, Artificial sequence
  specific aptamers
ggcugaggagaggaugcggug

SEQ ID NO: 3720 - RNA, 21 nt, Artificial sequence
  specific aptamers
ggcugaggagaggauguggag

SEQ ID NO: 3721 - RNA, 21 nt, Artificial sequence
  specific aptamers
ggcugaggagaggauguggcg

SEQ ID NO: 3722 - RNA, 21 nt, Artificial sequence
  specific aptamers
ggcugaggagaggauguggug

SEQ ID NO: 3723 - RNA, 20 nt, Artificial sequence
  specific aptamers
ggcugaggagaggagaggag

SEQ ID NO: 3724 - RNA, 20 nt, Artificial sequence
  specific aptamers
ggcugaggagaggagaggcg

SEQ ID NO: 3725 - RNA, 20 nt, Artificial sequence
  specific aptamers
ggcugaggagaggagaggug

SEQ ID NO: 3726 - RNA, 20 nt, Artificial sequence
  specific aptamers
ggcugaggagaggagcggag

SEQ ID NO: 3727 - RNA, 20 nt, Artificial sequence
  specific aptamers
ggcugaggagaggagcggcg

SEQ ID NO: 3728 - RNA, 20 nt, Artificial sequence
  specific aptamers
ggcugaggagaggagcggug

SEQ ID NO: 3729 - RNA, 20 nt, Artificial sequence
  specific aptamers
ggcugaggagaggaguggag

SEQ ID NO: 3730 - RNA, 20 nt, Artificial sequence
  specific aptamers
ggcugaggagaggaguggcg

SEQ ID NO: 3731 - RNA, 20 nt, Artificial sequence
  specific aptamers
ggcugaggagaggaguggug

SEQ ID NO: 3732 - RNA, 21 nt, Artificial sequence
  specific aptamers
ggcugaggagagguagaggag

SEQ ID NO: 3733 - RNA, 21 nt, Artificial sequence
  specific aptamers
ggcugaggagagguagaggcg

SEQ ID NO: 3734 - RNA, 21 nt, Artificial sequence
  specific aptamers
ggcugaggagagguagaggug

SEQ ID NO: 3735 - RNA, 21 nt, Artificial sequence
  specific aptamers
ggcugaggagagguagcggag

SEQ ID NO: 3736 - RNA, 21 nt, Artificial sequence
  specific aptamers
ggcugaggagagguagcggcg

SEQ ID NO: 3737 - RNA, 21 nt, Artificial sequence
  specific aptamers
ggcugaggagagguagcggug

SEQ ID NO: 3738 - RNA, 21 nt, Artificial sequence
  specific aptamers
ggcugaggagagguaguggag

SEQ ID NO: 3739 - RNA, 21 nt, Artificial sequence
  specific aptamers
ggcugaggagagguaguggcg

SEQ ID NO: 3740 - RNA, 21 nt, Artificial sequence
  specific aptamers
ggcugaggagagguaguggug

SEQ ID NO: 3741 - RNA, 21 nt, Artificial sequence
  specific aptamers
ggcugaggagagguugaggag

SEQ ID NO: 3742 - RNA, 21 nt, Artificial sequence
  specific aptamers
ggcugaggagagguugaggcg

SEQ ID NO: 3743 - RNA, 21 nt, Artificial sequence
  specific aptamers
ggcugaggagagguugaggug

SEQ ID NO: 3744 - RNA, 21 nt, Artificial sequence
  specific aptamers
ggcugaggagagguugcggag

SEQ ID NO: 3745 - RNA, 21 nt, Artificial sequence
  specific aptamers
ggcugaggagagguugcggcg

SEQ ID NO: 3746 - RNA, 21 nt, Artificial sequence
  specific aptamers
ggcugaggagagguugcggug

SEQ ID NO: 3747 - RNA, 21 nt, Artificial sequence
  specific aptamers
ggcugaggagagguuguggag

SEQ ID NO: 3748 - RNA, 21 nt, Artificial sequence
  specific aptamers
ggcugaggagagguuguggcg

SEQ ID NO: 3749 - RNA, 21 nt, Artificial sequence
  specific aptamers
ggcugaggagagguuguggug

SEQ ID NO: 3750 - RNA, 20 nt, Artificial sequence
  specific aptamers
ggcugaggagaggugaggag

SEQ ID NO: 3751 - RNA, 20 nt, Artificial sequence
  specific aptamers
ggcugaggagaggugaggcg

SEQ ID NO: 3752 - RNA, 20 nt, Artificial sequence
  specific aptamers
ggcugaggagaggugaggug

SEQ ID NO: 3753 - RNA, 20 nt, Artificial sequence
  specific aptamers
ggcugaggagaggugcggag

SEQ ID NO: 3754 - RNA, 20 nt, Artificial sequence
  specific aptamers
ggcugaggagaggugcggcg

SEQ ID NO: 3755 - RNA, 20 nt, Artificial sequence
  specific aptamers
ggcugaggagaggugcggug

SEQ ID NO: 3756 - RNA, 20 nt, Artificial sequence
  specific aptamers
ggcugaggagagguguggag

SEQ ID NO: 3757 - RNA, 20 nt, Artificial sequence
  specific aptamers
ggcugaggagagguguggcg

SEQ ID NO: 3758 - RNA, 20 nt, Artificial sequence
  specific aptamers
ggcugaggagagguguggug

SEQ ID NO: 3759 - RNA, 21 nt, Artificial sequence
  specific aptamers
ggcugaggaguggaagaggag

SEQ ID NO: 3760 - RNA, 21 nt, Artificial sequence
  specific aptamers
ggcugaggaguggaagaggcg

SEQ ID NO: 3761 - RNA, 21 nt, Artificial sequence
  specific aptamers
ggcugaggaguggaagaggug

SEQ ID NO: 3762 - RNA, 21 nt, Artificial sequence
  specific aptamers
ggcugaggaguggaagcggag

SEQ ID NO: 3763 - RNA, 21 nt, Artificial sequence
  specific aptamers
ggcugaggaguggaagcggcg

SEQ ID NO: 3764 - RNA, 21 nt, Artificial sequence
  specific aptamers
ggcugaggaguggaagcggug

SEQ ID NO: 3765 - RNA, 21 nt, Artificial sequence
  specific aptamers
ggcugaggaguggaaguggag

SEQ ID NO: 3766 - RNA, 21 nt, Artificial sequence
  specific aptamers
ggcugaggaguggaaguggcg

SEQ ID NO: 3767 - RNA, 21 nt, Artificial sequence
  specific aptamers
ggcugaggaguggaaguggug

SEQ ID NO: 3768 - RNA, 21 nt, Artificial sequence
  specific aptamers
ggcugaggaguggaugaggag

SEQ ID NO: 3769 - RNA, 21 nt, Artificial sequence
  specific aptamers
ggcugaggaguggaugaggcg

SEQ ID NO: 3770 - RNA, 21 nt, Artificial sequence
  specific aptamers
ggcugaggaguggaugaggug

SEQ ID NO: 3771 - RNA, 21 nt, Artificial sequence
  specific aptamers
ggcugaggaguggaugcggag

SEQ ID NO: 3772 - RNA, 21 nt, Artificial sequence
  specific aptamers
ggcugaggaguggaugcggcg

SEQ ID NO: 3773 - RNA, 21 nt, Artificial sequence
  specific aptamers
ggcugaggaguggaugcggug

SEQ ID NO: 3774 - RNA, 21 nt, Artificial sequence
  specific aptamers
ggcugaggaguggauguggag

SEQ ID NO: 3775 - RNA, 21 nt, Artificial sequence
  specific aptamers
ggcugaggaguggauguggcg

SEQ ID NO: 3776 - RNA, 21 nt, Artificial sequence
  specific aptamers
ggcugaggaguggauguggug

SEQ ID NO: 3777 - RNA, 20 nt, Artificial sequence
  specific aptamers
ggcugaggaguggagaggag

SEQ ID NO: 3778 - RNA, 20 nt, Artificial sequence
  specific aptamers
ggcugaggaguggagaggcg

SEQ ID NO: 3779 - RNA, 20 nt, Artificial sequence
  specific aptamers
ggcugaggaguggagaggug

SEQ ID NO: 3780 - RNA, 20 nt, Artificial sequence
  specific aptamers
ggcugaggaguggagcggag

SEQ ID NO: 3781 - RNA, 20 nt, Artificial sequence
  specific aptamers
ggcugaggaguggagcggcg

SEQ ID NO: 3782 - RNA, 20 nt, Artificial sequence
  specific aptamers
ggcugaggaguggagcggug

SEQ ID NO: 3783 - RNA, 20 nt, Artificial sequence
  specific aptamers
ggcugaggaguggaguggag

SEQ ID NO: 3784 - RNA, 20 nt, Artificial sequence
  specific aptamers
ggcugaggaguggaguggcg

SEQ ID NO: 3785 - RNA, 20 nt, Artificial sequence
  specific aptamers
ggcugaggaguggaguggug

SEQ ID NO: 3786 - RNA, 21 nt, Artificial sequence
  specific aptamers
ggcugaggagugguagaggag

SEQ ID NO: 3787 - RNA, 21 nt, Artificial sequence
  specific aptamers
ggcugaggagugguagaggcg

SEQ ID NO: 3788 - RNA, 21 nt, Artificial sequence
  specific aptamers
ggcugaggagugguagaggug

SEQ ID NO: 3789 - RNA, 21 nt, Artificial sequence
  specific aptamers
ggcugaggagugguagcggag

SEQ ID NO: 3790 - RNA, 21 nt, Artificial sequence
  specific aptamers
ggcugaggagugguagcggcg

SEQ ID NO: 3791 - RNA, 21 nt, Artificial sequence
  specific aptamers
ggcugaggagugguagcggug

SEQ ID NO: 3792 - RNA, 21 nt, Artificial sequence
  specific aptamers
ggcugaggagugguaguggag

SEQ ID NO: 3793 - RNA, 21 nt, Artificial sequence
  specific aptamers
ggcugaggagugguaguggcg

SEQ ID NO: 3794 - RNA, 21 nt, Artificial sequence
  specific aptamers
ggcugaggagugguaguggug

SEQ ID NO: 3795 - RNA, 21 nt, Artificial sequence
  specific aptamers
ggcugaggagugguugaggag

SEQ ID NO: 3796 - RNA, 21 nt, Artificial sequence
  specific aptamers
ggcugaggagugguugaggcg

SEQ ID NO: 3797 - RNA, 21 nt, Artificial sequence
  specific aptamers
ggcugaggagugguugaggug

SEQ ID NO: 3798 - RNA, 21 nt, Artificial sequence
  specific aptamers
ggcugaggagugguugcggag

SEQ ID NO: 3799 - RNA, 21 nt, Artificial sequence
  specific aptamers
ggcugaggagugguugcggcg

SEQ ID NO: 3800 - RNA, 21 nt, Artificial sequence
  specific aptamers
ggcugaggagugguugcggug

SEQ ID NO: 3801 - RNA, 21 nt, Artificial sequence
  specific aptamers
ggcugaggagugguuguggag

SEQ ID NO: 3802 - RNA, 21 nt, Artificial sequence
  specific aptamers
ggcugaggagugguuguggcg

SEQ ID NO: 3803 - RNA, 21 nt, Artificial sequence
  specific aptamers
ggcugaggagugguuguggug

SEQ ID NO: 3804 - RNA, 20 nt, Artificial sequence
  specific aptamers
ggcugaggaguggugaggag

SEQ ID NO: 3805 - RNA, 20 nt, Artificial sequence
  specific aptamers
ggcugaggaguggugaggcg

SEQ ID NO: 3806 - RNA, 20 nt, Artificial sequence
  specific aptamers
ggcugaggaguggugaggug

SEQ ID NO: 3807 - RNA, 20 nt, Artificial sequence
  specific aptamers
ggcugaggaguggugcggag

SEQ ID NO: 3808 - RNA, 20 nt, Artificial sequence
  specific aptamers
ggcugaggaguggugcggcg

SEQ ID NO: 3809 - RNA, 20 nt, Artificial sequence
  specific aptamers
ggcugaggaguggugcggug

SEQ ID NO: 3810 - RNA, 20 nt, Artificial sequence
  specific aptamers
ggcugaggagugguguggag

SEQ ID NO: 3811 - RNA, 20 nt, Artificial sequence
  specific aptamers
ggcugaggagugguguggcg

SEQ ID NO: 3812 - RNA, 20 nt, Artificial sequence
  specific aptamers
ggcugaggagugguguggug

SEQ ID NO: 3813 - RNA, 21 nt, Artificial sequence
  specific aptamers
ggcugaggugaggaagaggag

SEQ ID NO: 3814 - RNA, 21 nt, Artificial sequence
  specific aptamers
ggcugaggugaggaagaggcg

SEQ ID NO: 3815 - RNA, 21 nt, Artificial sequence
  specific aptamers
ggcugaggugaggaagaggug

SEQ ID NO: 3816 - RNA, 21 nt, Artificial sequence
  specific aptamers
ggcugaggugaggaagcggag

SEQ ID NO: 3817 - RNA, 21 nt, Artificial sequence
  specific aptamers
ggcugaggugaggaagcggcg

SEQ ID NO: 3818 - RNA, 21 nt, Artificial sequence
  specific aptamers
ggcugaggugaggaagcggug

SEQ ID NO: 3819 - RNA, 21 nt, Artificial sequence
  specific aptamers
ggcugaggugaggaaguggag

SEQ ID NO: 3820 - RNA, 21 nt, Artificial sequence
  specific aptamers
ggcugaggugaggaaguggcg

SEQ ID NO: 3821 - RNA, 21 nt, Artificial sequence
  specific aptamers
ggcugaggugaggaaguggug

SEQ ID NO: 3822 - RNA, 21 nt, Artificial sequence
  specific aptamers
ggcugaggugaggaugaggag

SEQ ID NO: 3823 - RNA, 21 nt, Artificial sequence
  specific aptamers
ggcugaggugaggaugaggcg

SEQ ID NO: 3824 - RNA, 21 nt, Artificial sequence
  specific aptamers
ggcugaggugaggaugaggug

SEQ ID NO: 3825 - RNA, 21 nt, Artificial sequence
  specific aptamers
ggcugaggugaggaugcggag

SEQ ID NO: 3826 - RNA, 21 nt, Artificial sequence
  specific aptamers
ggcugaggugaggaugcggcg

SEQ ID NO: 3827 - RNA, 21 nt, Artificial sequence
  specific aptamers
ggcugaggugaggaugcggug

SEQ ID NO: 3828 - RNA, 21 nt, Artificial sequence
  specific aptamers
ggcugaggugaggauguggag

SEQ ID NO: 3829 - RNA, 21 nt, Artificial sequence
  specific aptamers
ggcugaggugaggauguggcg

SEQ ID NO: 3830 - RNA, 21 nt, Artificial sequence
  specific aptamers
ggcugaggugaggauguggug

SEQ ID NO: 3831 - RNA, 20 nt, Artificial sequence
  specific aptamers
ggcugaggugaggagaggag

SEQ ID NO: 3832 - RNA, 20 nt, Artificial sequence
  specific aptamers
ggcugaggugaggagaggcg

SEQ ID NO: 3833 - RNA, 20 nt, Artificial sequence
  specific aptamers
ggcugaggugaggagaggug

SEQ ID NO: 3834 - RNA, 20 nt, Artificial sequence
  specific aptamers
ggcugaggugaggagcggag

SEQ ID NO: 3835 - RNA, 20 nt, Artificial sequence
  specific aptamers
ggcugaggugaggagcggcg

SEQ ID NO: 3836 - RNA, 20 nt, Artificial sequence
  specific aptamers
ggcugaggugaggagcggug

SEQ ID NO: 3837 - RNA, 20 nt, Artificial sequence
  specific aptamers
ggcugaggugaggaguggag

SEQ ID NO: 3838 - RNA, 20 nt, Artificial sequence
  specific aptamers
ggcugaggugaggaguggcg

SEQ ID NO: 3839 - RNA, 20 nt, Artificial sequence
  specific aptamers
ggcugaggugaggaguggug

SEQ ID NO: 3840 - RNA, 21 nt, Artificial sequence
  specific aptamers
ggcugaggugagguagaggag

SEQ ID NO: 3841 - RNA, 21 nt, Artificial sequence
  specific aptamers
ggcugaggugagguagaggcg

SEQ ID NO: 3842 - RNA, 21 nt, Artificial sequence
  specific aptamers
ggcugaggugagguagaggug

SEQ ID NO: 3843 - RNA, 21 nt, Artificial sequence
  specific aptamers
ggcugaggugagguagcggag

SEQ ID NO: 3844 - RNA, 21 nt, Artificial sequence
  specific aptamers
ggcugaggugagguagcggcg

SEQ ID NO: 3845 - RNA, 21 nt, Artificial sequence
  specific aptamers
ggcugaggugagguagcggug

SEQ ID NO: 3846 - RNA, 21 nt, Artificial sequence
  specific aptamers
ggcugaggugagguaguggag

SEQ ID NO: 3847 - RNA, 21 nt, Artificial sequence
  specific aptamers
ggcugaggugagguaguggcg

SEQ ID NO: 3848 - RNA, 21 nt, Artificial sequence
  specific aptamers
ggcugaggugagguaguggug

SEQ ID NO: 3849 - RNA, 21 nt, Artificial sequence
  specific aptamers
ggcugaggugagguugaggag

SEQ ID NO: 3850 - RNA, 21 nt, Artificial sequence
  specific aptamers
ggcugaggugagguugaggcg

SEQ ID NO: 3851 - RNA, 21 nt, Artificial sequence
  specific aptamers
ggcugaggugagguugaggug

SEQ ID NO: 3852 - RNA, 21 nt, Artificial sequence
  specific aptamers
ggcugaggugagguugcggag

SEQ ID NO: 3853 - RNA, 21 nt, Artificial sequence
  specific aptamers
ggcugaggugagguugcggcg

SEQ ID NO: 3854 - RNA, 21 nt, Artificial sequence
  specific aptamers
ggcugaggugagguugcggug

SEQ ID NO: 3855 - RNA, 21 nt, Artificial sequence
  specific aptamers
ggcugaggugagguuguggag

SEQ ID NO: 3856 - RNA, 21 nt, Artificial sequence
  specific aptamers
ggcugaggugagguuguggcg

SEQ ID NO: 3857 - RNA, 21 nt, Artificial sequence
  specific aptamers
ggcugaggugagguuguggug

SEQ ID NO: 3858 - RNA, 20 nt, Artificial sequence
  specific aptamers
ggcugaggugaggugaggag

SEQ ID NO: 3859 - RNA, 20 nt, Artificial sequence
  specific aptamers
ggcugaggugaggugaggcg

SEQ ID NO: 3860 - RNA, 20 nt, Artificial sequence
  specific aptamers
ggcugaggugaggugaggug

SEQ ID NO: 3861 - RNA, 20 nt, Artificial sequence
  specific aptamers
ggcugaggugaggugcggag

SEQ ID NO: 3862 - RNA, 20 nt, Artificial sequence
  specific aptamers
ggcugaggugaggugcggcg

SEQ ID NO: 3863 - RNA, 20 nt, Artificial sequence
  specific aptamers
ggcugaggugaggugcggug

SEQ ID NO: 3864 - RNA, 20 nt, Artificial sequence
  specific aptamers
ggcugaggugagguguggag

SEQ ID NO: 3865 - RNA, 20 nt, Artificial sequence
  specific aptamers
ggcugaggugagguguggcg

SEQ ID NO: 3866 - RNA, 20 nt, Artificial sequence
  specific aptamers
ggcugaggugagguguggug

SEQ ID NO: 3867 - RNA, 21 nt, Artificial sequence
  specific aptamers
ggcugagguguggaagaggag

SEQ ID NO: 3868 - RNA, 21 nt, Artificial sequence
  specific aptamers
ggcugagguguggaagaggcg

SEQ ID NO: 3869 - RNA, 21 nt, Artificial sequence
  specific aptamers
ggcugagguguggaagaggug

SEQ ID NO: 3870 - RNA, 21 nt, Artificial sequence
  specific aptamers
ggcugagguguggaagcggag

SEQ ID NO: 3871 - RNA, 21 nt, Artificial sequence
  specific aptamers
ggcugagguguggaagcggcg

SEQ ID NO: 3872 - RNA, 21 nt, Artificial sequence
  specific aptamers
ggcugagguguggaagcggug

SEQ ID NO: 3873 - RNA, 21 nt, Artificial sequence
  specific aptamers
ggcugagguguggaaguggag

SEQ ID NO: 3874 - RNA, 21 nt, Artificial sequence
  specific aptamers
ggcugagguguggaaguggcg

SEQ ID NO: 3875 - RNA, 21 nt, Artificial sequence
  specific aptamers
ggcugagguguggaaguggug

SEQ ID NO: 3876 - RNA, 21 nt, Artificial sequence
  specific aptamers
ggcugagguguggaugaggag

SEQ ID NO: 3877 - RNA, 21 nt, Artificial sequence
  specific aptamers
ggcugagguguggaugaggcg

SEQ ID NO: 3878 - RNA, 21 nt, Artificial sequence
  specific aptamers
ggcugagguguggaugaggug

SEQ ID NO: 3879 - RNA, 21 nt, Artificial sequence
  specific aptamers
ggcugagguguggaugcggag

SEQ ID NO: 3880 - RNA, 21 nt, Artificial sequence
  specific aptamers
ggcugagguguggaugcggcg

SEQ ID NO: 3881 - RNA, 21 nt, Artificial sequence
  specific aptamers
ggcugagguguggaugcggug

SEQ ID NO: 3882 - RNA, 21 nt, Artificial sequence
  specific aptamers
ggcugagguguggauguggag

SEQ ID NO: 3883 - RNA, 21 nt, Artificial sequence
  specific aptamers
ggcugagguguggauguggcg

SEQ ID NO: 3884 - RNA, 21 nt, Artificial sequence
  specific aptamers
ggcugagguguggauguggug

SEQ ID NO: 3885 - RNA, 20 nt, Artificial sequence
  specific aptamers
ggcugagguguggagaggag

SEQ ID NO: 3886 - RNA, 20 nt, Artificial sequence
  specific aptamers
ggcugagguguggagaggcg

SEQ ID NO: 3887 - RNA, 20 nt, Artificial sequence
  specific aptamers
ggcugagguguggagaggug

SEQ ID NO: 3888 - RNA, 20 nt, Artificial sequence
  specific aptamers
ggcugagguguggagcggag

SEQ ID NO: 3889 - RNA, 20 nt, Artificial sequence
  specific aptamers
ggcugagguguggagcggcg

SEQ ID NO: 3890 - RNA, 20 nt, Artificial sequence
  specific aptamers
ggcugagguguggagcggug

SEQ ID NO: 3891 - RNA, 20 nt, Artificial sequence
  specific aptamers
ggcugagguguggaguggag

SEQ ID NO: 3892 - RNA, 20 nt, Artificial sequence
  specific aptamers
ggcugagguguggaguggcg

SEQ ID NO: 3893 - RNA, 20 nt, Artificial sequence
  specific aptamers
ggcugagguguggaguggug

SEQ ID NO: 3894 - RNA, 21 nt, Artificial sequence
  specific aptamers
ggcugaggugugguagaggag

SEQ ID NO: 3895 - RNA, 21 nt, Artificial sequence
  specific aptamers
ggcugaggugugguagaggcg

SEQ ID NO: 3896 - RNA, 21 nt, Artificial sequence
  specific aptamers
ggcugaggugugguagaggug

SEQ ID NO: 3897 - RNA, 21 nt, Artificial sequence
  specific aptamers
ggcugaggugugguagcggag

SEQ ID NO: 3898 - RNA, 21 nt, Artificial sequence
  specific aptamers
ggcugaggugugguagcggcg

SEQ ID NO: 3899 - RNA, 21 nt, Artificial sequence
  specific aptamers
ggcugaggugugguagcggug

SEQ ID NO: 3900 - RNA, 21 nt, Artificial sequence
  specific aptamers
ggcugaggugugguaguggag

SEQ ID NO: 3901 - RNA, 21 nt, Artificial sequence
  specific aptamers
ggcugaggugugguaguggcg

SEQ ID NO: 3902 - RNA, 21 nt, Artificial sequence
  specific aptamers
ggcugaggugugguaguggug

SEQ ID NO: 3903 - RNA, 21 nt, Artificial sequence
  specific aptamers
ggcugaggugugguugaggag

SEQ ID NO: 3904 - RNA, 21 nt, Artificial sequence
  specific aptamers
ggcugaggugugguugaggcg

SEQ ID NO: 3905 - RNA, 21 nt, Artificial sequence
  specific aptamers
ggcugaggugugguugaggug

SEQ ID NO: 3906 - RNA, 21 nt, Artificial sequence
  specific aptamers
ggcugaggugugguugcggag

SEQ ID NO: 3907 - RNA, 21 nt, Artificial sequence
  specific aptamers
ggcugaggugugguugcggcg

SEQ ID NO: 3908 - RNA, 21 nt, Artificial sequence
  specific aptamers
ggcugaggugugguugcggug

SEQ ID NO: 3909 - RNA, 21 nt, Artificial sequence
  specific aptamers
ggcugaggugugguuguggag

SEQ ID NO: 3910 - RNA, 21 nt, Artificial sequence
  specific aptamers
ggcugaggugugguuguggcg

SEQ ID NO: 3911 - RNA, 21 nt, Artificial sequence
  specific aptamers
ggcugaggugugguuguggug

SEQ ID NO: 3912 - RNA, 20 nt, Artificial sequence
  specific aptamers
ggcugagguguggugaggag

SEQ ID NO: 3913 - RNA, 20 nt, Artificial sequence
  specific aptamers
ggcugagguguggugaggcg

SEQ ID NO: 3914 - RNA, 20 nt, Artificial sequence
  specific aptamers
ggcugagguguggugaggug

SEQ ID NO: 3915 - RNA, 20 nt, Artificial sequence
  specific aptamers
ggcugagguguggugcggag

SEQ ID NO: 3916 - RNA, 20 nt, Artificial sequence
  specific aptamers
ggcugagguguggugcggcg

SEQ ID NO: 3917 - RNA, 20 nt, Artificial sequence
  specific aptamers
ggcugagguguggugcggug

SEQ ID NO: 3918 - RNA, 20 nt, Artificial sequence
  specific aptamers
ggcugaggugugguguggag

SEQ ID NO: 3919 - RNA, 20 nt, Artificial sequence
  specific aptamers
ggcugaggugugguguggcg

SEQ ID NO: 3920 - RNA, 20 nt, Artificial sequence
  specific aptamers
ggcugaggugugguguggug

SEQ ID NO: 3921 - RNA, 21 nt, Artificial sequence
  specific aptamers
ggcuguggagaggaagaggag

SEQ ID NO: 3922 - RNA, 21 nt, Artificial sequence
  specific aptamers
ggcuguggagaggaagaggcg

SEQ ID NO: 3923 - RNA, 21 nt, Artificial sequence
  specific aptamers
ggcuguggagaggaagaggug

SEQ ID NO: 3924 - RNA, 21 nt, Artificial sequence
  specific aptamers
ggcuguggagaggaagcggag

SEQ ID NO: 3925 - RNA, 21 nt, Artificial sequence
  specific aptamers
ggcuguggagaggaagcggcg

SEQ ID NO: 3926 - RNA, 21 nt, Artificial sequence
  specific aptamers
ggcuguggagaggaagcggug

SEQ ID NO: 3927 - RNA, 21 nt, Artificial sequence
  specific aptamers
ggcuguggagaggaaguggag

SEQ ID NO: 3928 - RNA, 21 nt, Artificial sequence
  specific aptamers
ggcuguggagaggaaguggcg

SEQ ID NO: 3929 - RNA, 21 nt, Artificial sequence
  specific aptamers
ggcuguggagaggaaguggug

SEQ ID NO: 3930 - RNA, 21 nt, Artificial sequence
  specific aptamers
ggcuguggagaggaugaggag

SEQ ID NO: 3931 - RNA, 21 nt, Artificial sequence
  specific aptamers
ggcuguggagaggaugaggcg

SEQ ID NO: 3932 - RNA, 21 nt, Artificial sequence
  specific aptamers
ggcuguggagaggaugaggug

SEQ ID NO: 3933 - RNA, 21 nt, Artificial sequence
  specific aptamers
ggcuguggagaggaugcggag

SEQ ID NO: 3934 - RNA, 21 nt, Artificial sequence
  specific aptamers
ggcuguggagaggaugcggcg

SEQ ID NO: 3935 - RNA, 21 nt, Artificial sequence
  specific aptamers
ggcuguggagaggaugcggug

SEQ ID NO: 3936 - RNA, 21 nt, Artificial sequence
  specific aptamers
ggcuguggagaggauguggag

SEQ ID NO: 3937 - RNA, 21 nt, Artificial sequence
  specific aptamers
ggcuguggagaggauguggcg

SEQ ID NO: 3938 - RNA, 21 nt, Artificial sequence
  specific aptamers
ggcuguggagaggauguggug

SEQ ID NO: 3939 - RNA, 20 nt, Artificial sequence
  specific aptamers
ggcuguggagaggagaggag

SEQ ID NO: 3940 - RNA, 20 nt, Artificial sequence
  specific aptamers
ggcuguggagaggagaggcg

SEQ ID NO: 3941 - RNA, 20 nt, Artificial sequence
  specific aptamers
ggcuguggagaggagaggug

SEQ ID NO: 3942 - RNA, 20 nt, Artificial sequence
  specific aptamers
ggcuguggagaggagcggag

SEQ ID NO: 3943 - RNA, 20 nt, Artificial sequence
  specific aptamers
ggcuguggagaggagcggcg

SEQ ID NO: 3944 - RNA, 20 nt, Artificial sequence
  specific aptamers
ggcuguggagaggagcggug

SEQ ID NO: 3945 - RNA, 20 nt, Artificial sequence
  specific aptamers
ggcuguggagaggaguggag

SEQ ID NO: 3946 - RNA, 20 nt, Artificial sequence
  specific aptamers
ggcuguggagaggaguggcg

SEQ ID NO: 3947 - RNA, 20 nt, Artificial sequence
  specific aptamers
ggcuguggagaggaguggug

SEQ ID NO: 3948 - RNA, 21 nt, Artificial sequence
  specific aptamers
ggcuguggagagguagaggag

SEQ ID NO: 3949 - RNA, 21 nt, Artificial sequence
  specific aptamers
ggcuguggagagguagaggcg

SEQ ID NO: 3950 - RNA, 21 nt, Artificial sequence
  specific aptamers
ggcuguggagagguagaggug

SEQ ID NO: 3951 - RNA, 21 nt, Artificial sequence
  specific aptamers
ggcuguggagagguagcggag

SEQ ID NO: 3952 - RNA, 21 nt, Artificial sequence
  specific aptamers
ggcuguggagagguagcggcg

SEQ ID NO: 3953 - RNA, 21 nt, Artificial sequence
  specific aptamers
ggcuguggagagguagcggug

SEQ ID NO: 3954 - RNA, 21 nt, Artificial sequence
  specific aptamers
ggcuguggagagguaguggag

SEQ ID NO: 3955 - RNA, 21 nt, Artificial sequence
  specific aptamers
ggcuguggagagguaguggcg

SEQ ID NO: 3956 - RNA, 21 nt, Artificial sequence
  specific aptamers
ggcuguggagagguaguggug

SEQ ID NO: 3957 - RNA, 21 nt, Artificial sequence
  specific aptamers
ggcuguggagagguugaggag

SEQ ID NO: 3958 - RNA, 21 nt, Artificial sequence
  specific aptamers
ggcuguggagagguugaggcg

SEQ ID NO: 3959 - RNA, 21 nt, Artificial sequence
  specific aptamers
ggcuguggagagguugaggug

SEQ ID NO: 3960 - RNA, 21 nt, Artificial sequence
  specific aptamers
ggcuguggagagguugcggag

SEQ ID NO: 3961 - RNA, 21 nt, Artificial sequence
  specific aptamers
ggcuguggagagguugcggcg

SEQ ID NO: 3962 - RNA, 21 nt, Artificial sequence
  specific aptamers
ggcuguggagagguugcggug

SEQ ID NO: 3963 - RNA, 21 nt, Artificial sequence
  specific aptamers
ggcuguggagagguuguggag

SEQ ID NO: 3964 - RNA, 21 nt, Artificial sequence
  specific aptamers
ggcuguggagagguuguggcg

SEQ ID NO: 3965 - RNA, 21 nt, Artificial sequence
  specific aptamers
ggcuguggagagguuguggug

SEQ ID NO: 3966 - RNA, 20 nt, Artificial sequence
  specific aptamers
ggcuguggagaggugaggag

SEQ ID NO: 3967 - RNA, 20 nt, Artificial sequence
  specific aptamers
ggcuguggagaggugaggcg

SEQ ID NO: 3968 - RNA, 20 nt, Artificial sequence
  specific aptamers
ggcuguggagaggugaggug

SEQ ID NO: 3969 - RNA, 20 nt, Artificial sequence
  specific aptamers
ggcuguggagaggugcggag

SEQ ID NO: 3970 - RNA, 20 nt, Artificial sequence
  specific aptamers
ggcuguggagaggugcggcg

SEQ ID NO: 3971 - RNA, 20 nt, Artificial sequence
  specific aptamers
ggcuguggagaggugcggug

SEQ ID NO: 3972 - RNA, 20 nt, Artificial sequence
  specific aptamers
ggcuguggagagguguggag

SEQ ID NO: 3973 - RNA, 20 nt, Artificial sequence
  specific aptamers
ggcuguggagagguguggcg

SEQ ID NO: 3974 - RNA, 20 nt, Artificial sequence
  specific aptamers
ggcuguggagagguguggug

SEQ ID NO: 3975 - RNA, 21 nt, Artificial sequence
  specific aptamers
ggcuguggaguggaagaggag

SEQ ID NO: 3976 - RNA, 21 nt, Artificial sequence
  specific aptamers
ggcuguggaguggaagaggcg

SEQ ID NO: 3977 - RNA, 21 nt, Artificial sequence
  specific aptamers
ggcuguggaguggaagaggug

SEQ ID NO: 3978 - RNA, 21 nt, Artificial sequence
  specific aptamers
ggcuguggaguggaagcggag

SEQ ID NO: 3979 - RNA, 21 nt, Artificial sequence
  specific aptamers
ggcuguggaguggaagcggcg

SEQ ID NO: 3980 - RNA, 21 nt, Artificial sequence
  specific aptamers
ggcuguggaguggaagcggug

SEQ ID NO: 3981 - RNA, 21 nt, Artificial sequence
  specific aptamers
ggcuguggaguggaaguggag

SEQ ID NO: 3982 - RNA, 21 nt, Artificial sequence
  specific aptamers
ggcuguggaguggaaguggcg

SEQ ID NO: 3983 - RNA, 21 nt, Artificial sequence
  specific aptamers
ggcuguggaguggaaguggug

SEQ ID NO: 3984 - RNA, 21 nt, Artificial sequence
  specific aptamers
ggcuguggaguggaugaggag

SEQ ID NO: 3985 - RNA, 21 nt, Artificial sequence
  specific aptamers
ggcuguggaguggaugaggcg

SEQ ID NO: 3986 - RNA, 21 nt, Artificial sequence
  specific aptamers
ggcuguggaguggaugaggug

SEQ ID NO: 3987 - RNA, 21 nt, Artificial sequence
  specific aptamers
ggcuguggaguggaugcggag

SEQ ID NO: 3988 - RNA, 21 nt, Artificial sequence
  specific aptamers
ggcuguggaguggaugcggcg

SEQ ID NO: 3989 - RNA, 21 nt, Artificial sequence
  specific aptamers
ggcuguggaguggaugcggug

SEQ ID NO: 3990 - RNA, 21 nt, Artificial sequence
  specific aptamers
ggcuguggaguggauguggag

SEQ ID NO: 3991 - RNA, 21 nt, Artificial sequence
  specific aptamers
ggcuguggaguggauguggcg

SEQ ID NO: 3992 - RNA, 21 nt, Artificial sequence
  specific aptamers
ggcuguggaguggauguggug

SEQ ID NO: 3993 - RNA, 20 nt, Artificial sequence
  specific aptamers
ggcuguggaguggagaggag

SEQ ID NO: 3994 - RNA, 20 nt, Artificial sequence
  specific aptamers
ggcuguggaguggagaggcg

SEQ ID NO: 3995 - RNA, 20 nt, Artificial sequence
  specific aptamers
ggcuguggaguggagaggug

SEQ ID NO: 3996 - RNA, 20 nt, Artificial sequence
  specific aptamers
ggcuguggaguggagcggag

SEQ ID NO: 3997 - RNA, 20 nt, Artificial sequence
  specific aptamers
ggcuguggaguggagcggcg

SEQ ID NO: 3998 - RNA, 20 nt, Artificial sequence
  specific aptamers
ggcuguggaguggagcggug

SEQ ID NO: 3999 - RNA, 20 nt, Artificial sequence
  specific aptamers
ggcuguggaguggaguggag

SEQ ID NO: 4000 - RNA, 20 nt, Artificial sequence
  specific aptamers
ggcuguggaguggaguggcg

SEQ ID NO: 4001 - RNA, 20 nt, Artificial sequence
  specific aptamers
ggcuguggaguggaguggug

SEQ ID NO: 4002 - RNA, 21 nt, Artificial sequence
  specific aptamers
ggcuguggagugguagaggag

SEQ ID NO: 4003 - RNA, 21 nt, Artificial sequence
  specific aptamers
ggcuguggagugguagaggcg

SEQ ID NO: 4004 - RNA, 21 nt, Artificial sequence
  specific aptamers
ggcuguggagugguagaggug

SEQ ID NO: 4005 - RNA, 21 nt, Artificial sequence
  specific aptamers
ggcuguggagugguagcggag

SEQ ID NO: 4006 - RNA, 21 nt, Artificial sequence
  specific aptamers
ggcuguggagugguagcggcg

SEQ ID NO: 4007 - RNA, 21 nt, Artificial sequence
  specific aptamers
ggcuguggagugguagcggug

SEQ ID NO: 4008 - RNA, 21 nt, Artificial sequence
  specific aptamers
ggcuguggagugguaguggag

SEQ ID NO: 4009 - RNA, 21 nt, Artificial sequence
  specific aptamers
ggcuguggagugguaguggcg

SEQ ID NO: 4010 - RNA, 21 nt, Artificial sequence
  specific aptamers
ggcuguggagugguaguggug

SEQ ID NO: 4011 - RNA, 21 nt, Artificial sequence
  specific aptamers
ggcuguggagugguugaggag

SEQ ID NO: 4012 - RNA, 21 nt, Artificial sequence
  specific aptamers
ggcuguggagugguugaggcg

SEQ ID NO: 4013 - RNA, 21 nt, Artificial sequence
  specific aptamers
ggcuguggagugguugaggug

SEQ ID NO: 4014 - RNA, 21 nt, Artificial sequence
  specific aptamers
ggcuguggagugguugcggag

SEQ ID NO: 4015 - RNA, 21 nt, Artificial sequence
  specific aptamers
ggcuguggagugguugcggcg

SEQ ID NO: 4016 - RNA, 21 nt, Artificial sequence
  specific aptamers
ggcuguggagugguugcggug

SEQ ID NO: 4017 - RNA, 21 nt, Artificial sequence
  specific aptamers
ggcuguggagugguuguggag

SEQ ID NO: 4018 - RNA, 21 nt, Artificial sequence
  specific aptamers
ggcuguggagugguuguggcg

SEQ ID NO: 4019 - RNA, 21 nt, Artificial sequence
  specific aptamers
ggcuguggagugguuguggug

SEQ ID NO: 4020 - RNA, 20 nt, Artificial sequence
  specific aptamers
ggcuguggaguggugaggag

SEQ ID NO: 4021 - RNA, 20 nt, Artificial sequence
  specific aptamers
ggcuguggaguggugaggcg

SEQ ID NO: 4022 - RNA, 20 nt, Artificial sequence
  specific aptamers
ggcuguggaguggugaggug

SEQ ID NO: 4023 - RNA, 20 nt, Artificial sequence
  specific aptamers
ggcuguggaguggugcggag

SEQ ID NO: 4024 - RNA, 20 nt, Artificial sequence
  specific aptamers
ggcuguggaguggugcggcg

SEQ ID NO: 4025 - RNA, 20 nt, Artificial sequence
  specific aptamers
ggcuguggaguggugcggug

SEQ ID NO: 4026 - RNA, 20 nt, Artificial sequence
  specific aptamers
ggcuguggagugguguggag

SEQ ID NO: 4027 - RNA, 20 nt, Artificial sequence
  specific aptamers
ggcuguggagugguguggcg

SEQ ID NO: 4028 - RNA, 20 nt, Artificial sequence
  specific aptamers
ggcuguggagugguguggug

SEQ ID NO: 4029 - RNA, 21 nt, Artificial sequence
  specific aptamers
ggcuguggugaggaagaggag

SEQ ID NO: 4030 - RNA, 21 nt, Artificial sequence
  specific aptamers
ggcuguggugaggaagaggcg

SEQ ID NO: 4031 - RNA, 21 nt, Artificial sequence
  specific aptamers
ggcuguggugaggaagaggug

SEQ ID NO: 4032 - RNA, 21 nt, Artificial sequence
  specific aptamers
ggcuguggugaggaagcggag

SEQ ID NO: 4033 - RNA, 21 nt, Artificial sequence
  specific aptamers
ggcuguggugaggaagcggcg

SEQ ID NO: 4034 - RNA, 21 nt, Artificial sequence
  specific aptamers
ggcuguggugaggaagcggug

SEQ ID NO: 4035 - RNA, 21 nt, Artificial sequence
  specific aptamers
ggcuguggugaggaaguggag

SEQ ID NO: 4036 - RNA, 21 nt, Artificial sequence
  specific aptamers
ggcuguggugaggaaguggcg

SEQ ID NO: 4037 - RNA, 21 nt, Artificial sequence
  specific aptamers
ggcuguggugaggaaguggug

SEQ ID NO: 4038 - RNA, 21 nt, Artificial sequence
  specific aptamers
ggcuguggugaggaugaggag

SEQ ID NO: 4039 - RNA, 21 nt, Artificial sequence
  specific aptamers
ggcuguggugaggaugaggcg

SEQ ID NO: 4040 - RNA, 21 nt, Artificial sequence
  specific aptamers
ggcuguggugaggaugaggug

SEQ ID NO: 4041 - RNA, 21 nt, Artificial sequence
  specific aptamers
ggcuguggugaggaugcggag

SEQ ID NO: 4042 - RNA, 21 nt, Artificial sequence
  specific aptamers
ggcuguggugaggaugcggcg

SEQ ID NO: 4043 - RNA, 21 nt, Artificial sequence
  specific aptamers
ggcuguggugaggaugcggug

SEQ ID NO: 4044 - RNA, 21 nt, Artificial sequence
  specific aptamers
ggcuguggugaggauguggag

SEQ ID NO: 4045 - RNA, 21 nt, Artificial sequence
  specific aptamers
ggcuguggugaggauguggcg

SEQ ID NO: 4046 - RNA, 21 nt, Artificial sequence
  specific aptamers
ggcuguggugaggauguggug

SEQ ID NO: 4047 - RNA, 20 nt, Artificial sequence
  specific aptamers
ggcuguggugaggagaggag

SEQ ID NO: 4048 - RNA, 20 nt, Artificial sequence
  specific aptamers
ggcuguggugaggagaggcg

SEQ ID NO: 4049 - RNA, 20 nt, Artificial sequence
  specific aptamers
ggcuguggugaggagaggug

SEQ ID NO: 4050 - RNA, 20 nt, Artificial sequence
  specific aptamers
ggcuguggugaggagcggag

SEQ ID NO: 4051 - RNA, 20 nt, Artificial sequence
  specific aptamers
ggcuguggugaggagcggcg

SEQ ID NO: 4052 - RNA, 20 nt, Artificial sequence
  specific aptamers
ggcuguggugaggagcggug

SEQ ID NO: 4053 - RNA, 20 nt, Artificial sequence
  specific aptamers
ggcuguggugaggaguggag

SEQ ID NO: 4054 - RNA, 20 nt, Artificial sequence
  specific aptamers
ggcuguggugaggaguggcg

SEQ ID NO: 4055 - RNA, 20 nt, Artificial sequence
  specific aptamers
ggcuguggugaggaguggug

SEQ ID NO: 4056 - RNA, 21 nt, Artificial sequence
  specific aptamers
ggcuguggugagguagaggag

SEQ ID NO: 4057 - RNA, 21 nt, Artificial sequence
  specific aptamers
ggcuguggugagguagaggcg

SEQ ID NO: 4058 - RNA, 21 nt, Artificial sequence
  specific aptamers
ggcuguggugagguagaggug

SEQ ID NO: 4059 - RNA, 21 nt, Artificial sequence
  specific aptamers
ggcuguggugagguagcggag

SEQ ID NO: 4060 - RNA, 21 nt, Artificial sequence
  specific aptamers
ggcuguggugagguagcggcg

SEQ ID NO: 4061 - RNA, 21 nt, Artificial sequence
  specific aptamers
ggcuguggugagguagcggug

SEQ ID NO: 4062 - RNA, 21 nt, Artificial sequence
  specific aptamers
ggcuguggugagguaguggag

SEQ ID NO: 4063 - RNA, 21 nt, Artificial sequence
  specific aptamers
ggcuguggugagguaguggcg

SEQ ID NO: 4064 - RNA, 21 nt, Artificial sequence
  specific aptamers
ggcuguggugagguaguggug

SEQ ID NO: 4065 - RNA, 21 nt, Artificial sequence
  specific aptamers
ggcuguggugagguugaggag

SEQ ID NO: 4066 - RNA, 21 nt, Artificial sequence
  specific aptamers
ggcuguggugagguugaggcg

SEQ ID NO: 4067 - RNA, 21 nt, Artificial sequence
  specific aptamers
ggcuguggugagguugaggug

SEQ ID NO: 4068 - RNA, 21 nt, Artificial sequence
  specific aptamers
ggcuguggugagguugcggag

SEQ ID NO: 4069 - RNA, 21 nt, Artificial sequence
  specific aptamers
ggcuguggugagguugcggcg

SEQ ID NO: 4070 - RNA, 21 nt, Artificial sequence
  specific aptamers
ggcuguggugagguugcggug

SEQ ID NO: 4071 - RNA, 21 nt, Artificial sequence
  specific aptamers
ggcuguggugagguuguggag

SEQ ID NO: 4072 - RNA, 21 nt, Artificial sequence
  specific aptamers
ggcuguggugagguuguggcg

SEQ ID NO: 4073 - RNA, 21 nt, Artificial sequence
  specific aptamers
ggcuguggugagguuguggug

SEQ ID NO: 4074 - RNA, 20 nt, Artificial sequence
  specific aptamers
ggcuguggugaggugaggag

SEQ ID NO: 4075 - RNA, 20 nt, Artificial sequence
  specific aptamers
ggcuguggugaggugaggcg

SEQ ID NO: 4076 - RNA, 20 nt, Artificial sequence
  specific aptamers
ggcuguggugaggugaggug

SEQ ID NO: 4077 - RNA, 20 nt, Artificial sequence
  specific aptamers
ggcuguggugaggugcggag

SEQ ID NO: 4078 - RNA, 20 nt, Artificial sequence
  specific aptamers
ggcuguggugaggugcggcg

SEQ ID NO: 4079 - RNA, 20 nt, Artificial sequence
  specific aptamers
ggcuguggugaggugcggug

SEQ ID NO: 4080 - RNA, 20 nt, Artificial sequence
  specific aptamers
ggcuguggugagguguggag

SEQ ID NO: 4081 - RNA, 20 nt, Artificial sequence
  specific aptamers
ggcuguggugagguguggcg

SEQ ID NO: 4082 - RNA, 20 nt, Artificial sequence
  specific aptamers
ggcuguggugagguguggug

SEQ ID NO: 4083 - RNA, 21 nt, Artificial sequence
  specific aptamers
ggcugugguguggaagaggag

SEQ ID NO: 4084 - RNA, 21 nt, Artificial sequence
  specific aptamers
ggcugugguguggaagaggcg

SEQ ID NO: 4085 - RNA, 21 nt, Artificial sequence
  specific aptamers
ggcugugguguggaagaggug

SEQ ID NO: 4086 - RNA, 21 nt, Artificial sequence
  specific aptamers
ggcugugguguggaagcggag

SEQ ID NO: 4087 - RNA, 21 nt, Artificial sequence
  specific aptamers
ggcugugguguggaagcggcg

SEQ ID NO: 4088 - RNA, 21 nt, Artificial sequence
  specific aptamers
ggcugugguguggaagcggug

SEQ ID NO: 4089 - RNA, 21 nt, Artificial sequence
  specific aptamers
ggcugugguguggaaguggag

SEQ ID NO: 4090 - RNA, 21 nt, Artificial sequence
  specific aptamers
ggcugugguguggaaguggcg

SEQ ID NO: 4091 - RNA, 21 nt, Artificial sequence
  specific aptamers
ggcugugguguggaaguggug

SEQ ID NO: 4092 - RNA, 21 nt, Artificial sequence
  specific aptamers
ggcugugguguggaugaggag

SEQ ID NO: 4093 - RNA, 21 nt, Artificial sequence
  specific aptamers
ggcugugguguggaugaggcg

SEQ ID NO: 4094 - RNA, 21 nt, Artificial sequence
  specific aptamers
ggcugugguguggaugaggug

SEQ ID NO: 4095 - RNA, 21 nt, Artificial sequence
  specific aptamers
ggcugugguguggaugcggag

SEQ ID NO: 4096 - RNA, 21 nt, Artificial sequence
  specific aptamers
ggcugugguguggaugcggcg

SEQ ID NO: 4097 - RNA, 21 nt, Artificial sequence
  specific aptamers
ggcugugguguggaugcggug

SEQ ID NO: 4098 - RNA, 21 nt, Artificial sequence
  specific aptamers
ggcugugguguggauguggag

SEQ ID NO: 4099 - RNA, 21 nt, Artificial sequence
  specific aptamers
ggcugugguguggauguggcg

SEQ ID NO: 4100 - RNA, 21 nt, Artificial sequence
  specific aptamers
ggcugugguguggauguggug

SEQ ID NO: 4101 - RNA, 20 nt, Artificial sequence
  specific aptamers
ggcugugguguggagaggag

SEQ ID NO: 4102 - RNA, 20 nt, Artificial sequence
  specific aptamers
ggcugugguguggagaggcg

SEQ ID NO: 4103 - RNA, 20 nt, Artificial sequence
  specific aptamers
ggcugugguguggagaggug

SEQ ID NO: 4104 - RNA, 20 nt, Artificial sequence
  specific aptamers
ggcugugguguggagcggag

SEQ ID NO: 4105 - RNA, 20 nt, Artificial sequence
  specific aptamers
ggcugugguguggagcggcg

SEQ ID NO: 4106 - RNA, 20 nt, Artificial sequence
  specific aptamers
ggcugugguguggagcggug

SEQ ID NO: 4107 - RNA, 20 nt, Artificial sequence
  specific aptamers
ggcugugguguggaguggag

SEQ ID NO: 4108 - RNA, 20 nt, Artificial sequence
  specific aptamers
ggcugugguguggaguggcg

SEQ ID NO: 4109 - RNA, 20 nt, Artificial sequence
  specific aptamers
ggcugugguguggaguggug

SEQ ID NO: 4110 - RNA, 21 nt, Artificial sequence
  specific aptamers
ggcuguggugugguagaggag

SEQ ID NO: 4111 - RNA, 21 nt, Artificial sequence
  specific aptamers
ggcuguggugugguagaggcg

SEQ ID NO: 4112 - RNA, 21 nt, Artificial sequence
  specific aptamers
ggcuguggugugguagaggug

SEQ ID NO: 4113 - RNA, 21 nt, Artificial sequence
  specific aptamers
ggcuguggugugguagcggag

SEQ ID NO: 4114 - RNA, 21 nt, Artificial sequence
  specific aptamers
ggcuguggugugguagcggcg

SEQ ID NO: 4115 - RNA, 21 nt, Artificial sequence
  specific aptamers
ggcuguggugugguagcggug

SEQ ID NO: 4116 - RNA, 21 nt, Artificial sequence
  specific aptamers
ggcuguggugugguaguggag

SEQ ID NO: 4117 - RNA, 21 nt, Artificial sequence
  specific aptamers
ggcuguggugugguaguggcg

SEQ ID NO: 4118 - RNA, 21 nt, Artificial sequence
  specific aptamers
ggcuguggugugguaguggug

SEQ ID NO: 4119 - RNA, 21 nt, Artificial sequence
  specific aptamers
ggcuguggugugguugaggag

SEQ ID NO: 4120 - RNA, 21 nt, Artificial sequence
  specific aptamers
ggcuguggugugguugaggcg

SEQ ID NO: 4121 - RNA, 21 nt, Artificial sequence
  specific aptamers
ggcuguggugugguugaggug

SEQ ID NO: 4122 - RNA, 21 nt, Artificial sequence
  specific aptamers
ggcuguggugugguugcggag

SEQ ID NO: 4123 - RNA, 21 nt, Artificial sequence
  specific aptamers
ggcuguggugugguugcggcg

SEQ ID NO: 4124 - RNA, 21 nt, Artificial sequence
  specific aptamers
ggcuguggugugguugcggug

SEQ ID NO: 4125 - RNA, 21 nt, Artificial sequence
  specific aptamers
ggcuguggugugguuguggag

SEQ ID NO: 4126 - RNA, 21 nt, Artificial sequence
  specific aptamers
ggcuguggugugguuguggcg

SEQ ID NO: 4127 - RNA, 21 nt, Artificial sequence
  specific aptamers
ggcuguggugugguuguggug

SEQ ID NO: 4128 - RNA, 20 nt, Artificial sequence
  specific aptamers
ggcugugguguggugaggag

SEQ ID NO: 4129 - RNA, 20 nt, Artificial sequence
  specific aptamers
ggcugugguguggugaggcg

SEQ ID NO: 4130 - RNA, 20 nt, Artificial sequence
  specific aptamers
ggcugugguguggugaggug

SEQ ID NO: 4131 - RNA, 20 nt, Artificial sequence
  specific aptamers
ggcugugguguggugcggag

SEQ ID NO: 4132 - RNA, 20 nt, Artificial sequence
  specific aptamers
ggcugugguguggugcggcg

SEQ ID NO: 4133 - RNA, 20 nt, Artificial sequence
  specific aptamers
ggcugugguguggugcggug

SEQ ID NO: 4134 - RNA, 20 nt, Artificial sequence
  specific aptamers
ggcuguggugugguguggag

SEQ ID NO: 4135 - RNA, 20 nt, Artificial sequence
  specific aptamers
ggcuguggugugguguggcg

SEQ ID NO: 4136 - RNA, 20 nt, Artificial sequence
  specific aptamers
ggcuguggugugguguggug

SEQ ID NO: 4137 - RNA, 21 nt, Artificial sequence
  specific aptamers
gggagaggagaggaagaggag

SEQ ID NO: 4138 - RNA, 21 nt, Artificial sequence
  specific aptamers
gggagaggagaggaagaggcg

SEQ ID NO: 4139 - RNA, 21 nt, Artificial sequence
  specific aptamers
gggagaggagaggaagaggug

SEQ ID NO: 4140 - RNA, 21 nt, Artificial sequence
  specific aptamers
gggagaggagaggaagcggag

SEQ ID NO: 4141 - RNA, 21 nt, Artificial sequence
  specific aptamers
gggagaggagaggaagcggcg

SEQ ID NO: 4142 - RNA, 21 nt, Artificial sequence
  specific aptamers
gggagaggagaggaagcggug

SEQ ID NO: 4143 - RNA, 21 nt, Artificial sequence
  specific aptamers
gggagaggagaggaaguggag

SEQ ID NO: 4144 - RNA, 21 nt, Artificial sequence
  specific aptamers
gggagaggagaggaaguggcg

SEQ ID NO: 4145 - RNA, 21 nt, Artificial sequence
  specific aptamers
gggagaggagaggaaguggug

SEQ ID NO: 4146 - RNA, 21 nt, Artificial sequence
  specific aptamers
gggagaggagaggaugaggag

SEQ ID NO: 4147 - RNA, 21 nt, Artificial sequence
  specific aptamers
gggagaggagaggaugaggcg

SEQ ID NO: 4148 - RNA, 21 nt, Artificial sequence
  specific aptamers
gggagaggagaggaugaggug

SEQ ID NO: 4149 - RNA, 21 nt, Artificial sequence
  specific aptamers
gggagaggagaggaugcggag

SEQ ID NO: 4150 - RNA, 21 nt, Artificial sequence
  specific aptamers
gggagaggagaggaugcggcg

SEQ ID NO: 4151 - RNA, 21 nt, Artificial sequence
  specific aptamers
gggagaggagaggaugcggug

SEQ ID NO: 4152 - RNA, 21 nt, Artificial sequence
  specific aptamers
gggagaggagaggauguggag

SEQ ID NO: 4153 - RNA, 21 nt, Artificial sequence
  specific aptamers
gggagaggagaggauguggcg

SEQ ID NO: 4154 - RNA, 21 nt, Artificial sequence
  specific aptamers
gggagaggagaggauguggug

SEQ ID NO: 4155 - RNA, 20 nt, Artificial sequence
  specific aptamers
gggagaggagaggagaggag

SEQ ID NO: 4156 - RNA, 20 nt, Artificial sequence
  specific aptamers
gggagaggagaggagaggcg

SEQ ID NO: 4157 - RNA, 20 nt, Artificial sequence
  specific aptamers
gggagaggagaggagaggug

SEQ ID NO: 4158 - RNA, 20 nt, Artificial sequence
  specific aptamers
gggagaggagaggagcggag

SEQ ID NO: 4159 - RNA, 20 nt, Artificial sequence
  specific aptamers
gggagaggagaggagcggcg

SEQ ID NO: 4160 - RNA, 20 nt, Artificial sequence
  specific aptamers
gggagaggagaggagcggug

SEQ ID NO: 4161 - RNA, 20 nt, Artificial sequence
  specific aptamers
gggagaggagaggaguggag

SEQ ID NO: 4162 - RNA, 20 nt, Artificial sequence
  specific aptamers
gggagaggagaggaguggcg

SEQ ID NO: 4163 - RNA, 20 nt, Artificial sequence
  specific aptamers
gggagaggagaggaguggug

SEQ ID NO: 4164 - RNA, 21 nt, Artificial sequence
  specific aptamers
gggagaggagagguagaggag

SEQ ID NO: 4165 - RNA, 21 nt, Artificial sequence
  specific aptamers
gggagaggagagguagaggcg

SEQ ID NO: 4166 - RNA, 21 nt, Artificial sequence
  specific aptamers
gggagaggagagguagaggug

SEQ ID NO: 4167 - RNA, 21 nt, Artificial sequence
  specific aptamers
gggagaggagagguagcggag

SEQ ID NO: 4168 - RNA, 21 nt, Artificial sequence
  specific aptamers
gggagaggagagguagcggcg

SEQ ID NO: 4169 - RNA, 21 nt, Artificial sequence
  specific aptamers
gggagaggagagguagcggug

SEQ ID NO: 4170 - RNA, 21 nt, Artificial sequence
  specific aptamers
gggagaggagagguaguggag

SEQ ID NO: 4171 - RNA, 21 nt, Artificial sequence
  specific aptamers
gggagaggagagguaguggcg

SEQ ID NO: 4172 - RNA, 21 nt, Artificial sequence
  specific aptamers
gggagaggagagguaguggug

SEQ ID NO: 4173 - RNA, 21 nt, Artificial sequence
  specific aptamers
gggagaggagagguugaggag

SEQ ID NO: 4174 - RNA, 21 nt, Artificial sequence
  specific aptamers
gggagaggagagguugaggcg

SEQ ID NO: 4175 - RNA, 21 nt, Artificial sequence
  specific aptamers
gggagaggagagguugaggug

SEQ ID NO: 4176 - RNA, 21 nt, Artificial sequence
  specific aptamers
gggagaggagagguugcggag

SEQ ID NO: 4177 - RNA, 21 nt, Artificial sequence
  specific aptamers
gggagaggagagguugcggcg

SEQ ID NO: 4178 - RNA, 21 nt, Artificial sequence
  specific aptamers
gggagaggagagguugcggug

SEQ ID NO: 4179 - RNA, 21 nt, Artificial sequence
  specific aptamers
gggagaggagagguuguggag

SEQ ID NO: 4180 - RNA, 21 nt, Artificial sequence
  specific aptamers
gggagaggagagguuguggcg

SEQ ID NO: 4181 - RNA, 21 nt, Artificial sequence
  specific aptamers
gggagaggagagguuguggug

SEQ ID NO: 4182 - RNA, 20 nt, Artificial sequence
  specific aptamers
gggagaggagaggugaggag

SEQ ID NO: 4183 - RNA, 20 nt, Artificial sequence
  specific aptamers
gggagaggagaggugaggcg

SEQ ID NO: 4184 - RNA, 20 nt, Artificial sequence
  specific aptamers
gggagaggagaggugaggug

SEQ ID NO: 4185 - RNA, 20 nt, Artificial sequence
  specific aptamers
gggagaggagaggugcggag

SEQ ID NO: 4186 - RNA, 20 nt, Artificial sequence
  specific aptamers
gggagaggagaggugcggcg

SEQ ID NO: 4187 - RNA, 20 nt, Artificial sequence
  specific aptamers
gggagaggagaggugcggug

SEQ ID NO: 4188 - RNA, 20 nt, Artificial sequence
  specific aptamers
gggagaggagagguguggag

SEQ ID NO: 4189 - RNA, 20 nt, Artificial sequence
  specific aptamers
gggagaggagagguguggcg

SEQ ID NO: 4190 - RNA, 20 nt, Artificial sequence
  specific aptamers
gggagaggagagguguggug

SEQ ID NO: 4191 - RNA, 21 nt, Artificial sequence
  specific aptamers
gggagaggaguggaagaggag

SEQ ID NO: 4192 - RNA, 21 nt, Artificial sequence
  specific aptamers
gggagaggaguggaagaggcg

SEQ ID NO: 4193 - RNA, 21 nt, Artificial sequence
  specific aptamers
gggagaggaguggaagaggug

SEQ ID NO: 4194 - RNA, 21 nt, Artificial sequence
  specific aptamers
gggagaggaguggaagcggag

SEQ ID NO: 4195 - RNA, 21 nt, Artificial sequence
  specific aptamers
gggagaggaguggaagcggcg

SEQ ID NO: 4196 - RNA, 21 nt, Artificial sequence
  specific aptamers
gggagaggaguggaagcggug

SEQ ID NO: 4197 - RNA, 21 nt, Artificial sequence
  specific aptamers
gggagaggaguggaaguggag

SEQ ID NO: 4198 - RNA, 21 nt, Artificial sequence
  specific aptamers
gggagaggaguggaaguggcg

SEQ ID NO: 4199 - RNA, 21 nt, Artificial sequence
  specific aptamers
gggagaggaguggaaguggug

SEQ ID NO: 4200 - RNA, 21 nt, Artificial sequence
  specific aptamers
gggagaggaguggaugaggag

SEQ ID NO: 4201 - RNA, 21 nt, Artificial sequence
  specific aptamers
gggagaggaguggaugaggcg

SEQ ID NO: 4202 - RNA, 21 nt, Artificial sequence
  specific aptamers
gggagaggaguggaugaggug

SEQ ID NO: 4203 - RNA, 21 nt, Artificial sequence
  specific aptamers
gggagaggaguggaugcggag

SEQ ID NO: 4204 - RNA, 21 nt, Artificial sequence
  specific aptamers
gggagaggaguggaugcggcg

SEQ ID NO: 4205 - RNA, 21 nt, Artificial sequence
  specific aptamers
gggagaggaguggaugcggug

SEQ ID NO: 4206 - RNA, 21 nt, Artificial sequence
  specific aptamers
gggagaggaguggauguggag

SEQ ID NO: 4207 - RNA, 21 nt, Artificial sequence
  specific aptamers
gggagaggaguggauguggcg

SEQ ID NO: 4208 - RNA, 21 nt, Artificial sequence
  specific aptamers
gggagaggaguggauguggug

SEQ ID NO: 4209 - RNA, 20 nt, Artificial sequence
  specific aptamers
gggagaggaguggagaggag

SEQ ID NO: 4210 - RNA, 20 nt, Artificial sequence
  specific aptamers
gggagaggaguggagaggcg

SEQ ID NO: 4211 - RNA, 20 nt, Artificial sequence
  specific aptamers
gggagaggaguggagaggug

SEQ ID NO: 4212 - RNA, 20 nt, Artificial sequence
  specific aptamers
gggagaggaguggagcggag

SEQ ID NO: 4213 - RNA, 20 nt, Artificial sequence
  specific aptamers
gggagaggaguggagcggcg

SEQ ID NO: 4214 - RNA, 20 nt, Artificial sequence
  specific aptamers
gggagaggaguggagcggug

SEQ ID NO: 4215 - RNA, 20 nt, Artificial sequence
  specific aptamers
gggagaggaguggaguggag

SEQ ID NO: 4216 - RNA, 20 nt, Artificial sequence
  specific aptamers
gggagaggaguggaguggcg

SEQ ID NO: 4217 - RNA, 20 nt, Artificial sequence
  specific aptamers
gggagaggaguggaguggug

SEQ ID NO: 4218 - RNA, 21 nt, Artificial sequence
  specific aptamers
gggagaggagugguagaggag

SEQ ID NO: 4219 - RNA, 21 nt, Artificial sequence
  specific aptamers
gggagaggagugguagaggcg

SEQ ID NO: 4220 - RNA, 21 nt, Artificial sequence
  specific aptamers
gggagaggagugguagaggug

SEQ ID NO: 4221 - RNA, 21 nt, Artificial sequence
  specific aptamers
gggagaggagugguagcggag

SEQ ID NO: 4222 - RNA, 21 nt, Artificial sequence
  specific aptamers
gggagaggagugguagcggcg

SEQ ID NO: 4223 - RNA, 21 nt, Artificial sequence
  specific aptamers
gggagaggagugguagcggug

SEQ ID NO: 4224 - RNA, 21 nt, Artificial sequence
  specific aptamers
gggagaggagugguaguggag

SEQ ID NO: 4225 - RNA, 21 nt, Artificial sequence
  specific aptamers
gggagaggagugguaguggcg

SEQ ID NO: 4226 - RNA, 21 nt, Artificial sequence
  specific aptamers
gggagaggagugguaguggug

SEQ ID NO: 4227 - RNA, 21 nt, Artificial sequence
  specific aptamers
gggagaggagugguugaggag

SEQ ID NO: 4228 - RNA, 21 nt, Artificial sequence
  specific aptamers
gggagaggagugguugaggcg

SEQ ID NO: 4229 - RNA, 21 nt, Artificial sequence
  specific aptamers
gggagaggagugguugaggug

SEQ ID NO: 4230 - RNA, 21 nt, Artificial sequence
  specific aptamers
gggagaggagugguugcggag

SEQ ID NO: 4231 - RNA, 21 nt, Artificial sequence
  specific aptamers
gggagaggagugguugcggcg

SEQ ID NO: 4232 - RNA, 21 nt, Artificial sequence
  specific aptamers
gggagaggagugguugcggug

SEQ ID NO: 4233 - RNA, 21 nt, Artificial sequence
  specific aptamers
gggagaggagugguuguggag

SEQ ID NO: 4234 - RNA, 21 nt, Artificial sequence
  specific aptamers
gggagaggagugguuguggcg

SEQ ID NO: 4235 - RNA, 21 nt, Artificial sequence
  specific aptamers
gggagaggagugguuguggug

SEQ ID NO: 4236 - RNA, 20 nt, Artificial sequence
  specific aptamers
gggagaggaguggugaggag

SEQ ID NO: 4237 - RNA, 20 nt, Artificial sequence
  specific aptamers
gggagaggaguggugaggcg

SEQ ID NO: 4238 - RNA, 20 nt, Artificial sequence
  specific aptamers
gggagaggaguggugaggug

SEQ ID NO: 4239 - RNA, 20 nt, Artificial sequence
  specific aptamers
gggagaggaguggugcggag

SEQ ID NO: 4240 - RNA, 20 nt, Artificial sequence
  specific aptamers
gggagaggaguggugcggcg

SEQ ID NO: 4241 - RNA, 20 nt, Artificial sequence
  specific aptamers
gggagaggaguggugcggug

SEQ ID NO: 4242 - RNA, 20 nt, Artificial sequence
  specific aptamers
gggagaggagugguguggag

SEQ ID NO: 4243 - RNA, 20 nt, Artificial sequence
  specific aptamers
gggagaggagugguguggcg

SEQ ID NO: 4244 - RNA, 20 nt, Artificial sequence
  specific aptamers
gggagaggagugguguggug

SEQ ID NO: 4245 - RNA, 21 nt, Artificial sequence
  specific aptamers
gggagaggugaggaagaggag

SEQ ID NO: 4246 - RNA, 21 nt, Artificial sequence
  specific aptamers
gggagaggugaggaagaggcg

SEQ ID NO: 4247 - RNA, 21 nt, Artificial sequence
  specific aptamers
gggagaggugaggaagaggug

SEQ ID NO: 4248 - RNA, 21 nt, Artificial sequence
  specific aptamers
gggagaggugaggaagcggag

SEQ ID NO: 4249 - RNA, 21 nt, Artificial sequence
  specific aptamers
gggagaggugaggaagcggcg

SEQ ID NO: 4250 - RNA, 21 nt, Artificial sequence
  specific aptamers
gggagaggugaggaagcggug

SEQ ID NO: 4251 - RNA, 21 nt, Artificial sequence
  specific aptamers
gggagaggugaggaaguggag

SEQ ID NO: 4252 - RNA, 21 nt, Artificial sequence
  specific aptamers
gggagaggugaggaaguggcg

SEQ ID NO: 4253 - RNA, 21 nt, Artificial sequence
  specific aptamers
gggagaggugaggaaguggug

SEQ ID NO: 4254 - RNA, 21 nt, Artificial sequence
  specific aptamers
gggagaggugaggaugaggag

SEQ ID NO: 4255 - RNA, 21 nt, Artificial sequence
  specific aptamers
gggagaggugaggaugaggcg

SEQ ID NO: 4256 - RNA, 21 nt, Artificial sequence
  specific aptamers
gggagaggugaggaugaggug

SEQ ID NO: 4257 - RNA, 21 nt, Artificial sequence
  specific aptamers
gggagaggugaggaugcggag

SEQ ID NO: 4258 - RNA, 21 nt, Artificial sequence
  specific aptamers
gggagaggugaggaugcggcg

SEQ ID NO: 4259 - RNA, 21 nt, Artificial sequence
  specific aptamers
gggagaggugaggaugcggug

SEQ ID NO: 4260 - RNA, 21 nt, Artificial sequence
  specific aptamers
gggagaggugaggauguggag

SEQ ID NO: 4261 - RNA, 21 nt, Artificial sequence
  specific aptamers
gggagaggugaggauguggcg

SEQ ID NO: 4262 - RNA, 21 nt, Artificial sequence
  specific aptamers
gggagaggugaggauguggug

SEQ ID NO: 4263 - RNA, 20 nt, Artificial sequence
  specific aptamers
gggagaggugaggagaggag

SEQ ID NO: 4264 - RNA, 20 nt, Artificial sequence
  specific aptamers
gggagaggugaggagaggcg

SEQ ID NO: 4265 - RNA, 20 nt, Artificial sequence
  specific aptamers
gggagaggugaggagaggug

SEQ ID NO: 4266 - RNA, 20 nt, Artificial sequence
  specific aptamers
gggagaggugaggagcggag

SEQ ID NO: 4267 - RNA, 20 nt, Artificial sequence
  specific aptamers
gggagaggugaggagcggcg

SEQ ID NO: 4268 - RNA, 20 nt, Artificial sequence
  specific aptamers
gggagaggugaggagcggug

SEQ ID NO: 4269 - RNA, 20 nt, Artificial sequence
  specific aptamers
gggagaggugaggaguggag

SEQ ID NO: 4270 - RNA, 20 nt, Artificial sequence
  specific aptamers
gggagaggugaggaguggcg

SEQ ID NO: 4271 - RNA, 20 nt, Artificial sequence
  specific aptamers
gggagaggugaggaguggug

SEQ ID NO: 4272 - RNA, 21 nt, Artificial sequence
  specific aptamers
gggagaggugagguagaggag

SEQ ID NO: 4273 - RNA, 21 nt, Artificial sequence
  specific aptamers
gggagaggugagguagaggcg

SEQ ID NO: 4274 - RNA, 21 nt, Artificial sequence
  specific aptamers
gggagaggugagguagaggug

SEQ ID NO: 4275 - RNA, 21 nt, Artificial sequence
  specific aptamers
gggagaggugagguagcggag

SEQ ID NO: 4276 - RNA, 21 nt, Artificial sequence
  specific aptamers
gggagaggugagguagcggcg

SEQ ID NO: 4277 - RNA, 21 nt, Artificial sequence
  specific aptamers
gggagaggugagguagcggug

SEQ ID NO: 4278 - RNA, 21 nt, Artificial sequence
  specific aptamers
gggagaggugagguaguggag

SEQ ID NO: 4279 - RNA, 21 nt, Artificial sequence
  specific aptamers
gggagaggugagguaguggcg

SEQ ID NO: 4280 - RNA, 21 nt, Artificial sequence
  specific aptamers
gggagaggugagguaguggug

SEQ ID NO: 4281 - RNA, 21 nt, Artificial sequence
  specific aptamers
gggagaggugagguugaggag

SEQ ID NO: 4282 - RNA, 21 nt, Artificial sequence
  specific aptamers
gggagaggugagguugaggcg

SEQ ID NO: 4283 - RNA, 21 nt, Artificial sequence
  specific aptamers
gggagaggugagguugaggug

SEQ ID NO: 4284 - RNA, 21 nt, Artificial sequence
  specific aptamers
gggagaggugagguugcggag

SEQ ID NO: 4285 - RNA, 21 nt, Artificial sequence
  specific aptamers
gggagaggugagguugcggcg

SEQ ID NO: 4286 - RNA, 21 nt, Artificial sequence
  specific aptamers
gggagaggugagguugcggug

SEQ ID NO: 4287 - RNA, 21 nt, Artificial sequence
  specific aptamers
gggagaggugagguuguggag

SEQ ID NO: 4288 - RNA, 21 nt, Artificial sequence
  specific aptamers
gggagaggugagguuguggcg

SEQ ID NO: 4289 - RNA, 21 nt, Artificial sequence
  specific aptamers
gggagaggugagguuguggug

SEQ ID NO: 4290 - RNA, 20 nt, Artificial sequence
  specific aptamers
gggagaggugaggugaggag

SEQ ID NO: 4291 - RNA, 20 nt, Artificial sequence
  specific aptamers
gggagaggugaggugaggcg

SEQ ID NO: 4292 - RNA, 20 nt, Artificial sequence
  specific aptamers
gggagaggugaggugaggug

SEQ ID NO: 4293 - RNA, 20 nt, Artificial sequence
  specific aptamers
gggagaggugaggugcggag

SEQ ID NO: 4294 - RNA, 20 nt, Artificial sequence
  specific aptamers
gggagaggugaggugcggcg

SEQ ID NO: 4295 - RNA, 20 nt, Artificial sequence
  specific aptamers
gggagaggugaggugcggug

SEQ ID NO: 4296 - RNA, 20 nt, Artificial sequence
  specific aptamers
gggagaggugagguguggag

SEQ ID NO: 4297 - RNA, 20 nt, Artificial sequence
  specific aptamers
gggagaggugagguguggcg

SEQ ID NO: 4298 - RNA, 20 nt, Artificial sequence
  specific aptamers
gggagaggugagguguggug

SEQ ID NO: 4299 - RNA, 21 nt, Artificial sequence
  specific aptamers
gggagagguguggaagaggag

SEQ ID NO: 4300 - RNA, 21 nt, Artificial sequence
  specific aptamers
gggagagguguggaagaggcg

SEQ ID NO: 4301 - RNA, 21 nt, Artificial sequence
  specific aptamers
gggagagguguggaagaggug

SEQ ID NO: 4302 - RNA, 21 nt, Artificial sequence
  specific aptamers
gggagagguguggaagcggag

SEQ ID NO: 4303 - RNA, 21 nt, Artificial sequence
  specific aptamers
gggagagguguggaagcggcg

SEQ ID NO: 4304 - RNA, 21 nt, Artificial sequence
  specific aptamers
gggagagguguggaagcggug

SEQ ID NO: 4305 - RNA, 21 nt, Artificial sequence
  specific aptamers
gggagagguguggaaguggag

SEQ ID NO: 4306 - RNA, 21 nt, Artificial sequence
  specific aptamers
gggagagguguggaaguggcg

SEQ ID NO: 4307 - RNA, 21 nt, Artificial sequence
  specific aptamers
gggagagguguggaaguggug

SEQ ID NO: 4308 - RNA, 21 nt, Artificial sequence
  specific aptamers
gggagagguguggaugaggag

SEQ ID NO: 4309 - RNA, 21 nt, Artificial sequence
  specific aptamers
gggagagguguggaugaggcg

SEQ ID NO: 4310 - RNA, 21 nt, Artificial sequence
  specific aptamers
gggagagguguggaugaggug

SEQ ID NO: 4311 - RNA, 21 nt, Artificial sequence
  specific aptamers
gggagagguguggaugcggag

SEQ ID NO: 4312 - RNA, 21 nt, Artificial sequence
  specific aptamers
gggagagguguggaugcggcg

SEQ ID NO: 4313 - RNA, 21 nt, Artificial sequence
  specific aptamers
gggagagguguggaugcggug

SEQ ID NO: 4314 - RNA, 21 nt, Artificial sequence
  specific aptamers
gggagagguguggauguggag

SEQ ID NO: 4315 - RNA, 21 nt, Artificial sequence
  specific aptamers
gggagagguguggauguggcg

SEQ ID NO: 4316 - RNA, 21 nt, Artificial sequence
  specific aptamers
gggagagguguggauguggug

SEQ ID NO: 4317 - RNA, 20 nt, Artificial sequence
  specific aptamers
gggagagguguggagaggag

SEQ ID NO: 4318 - RNA, 20 nt, Artificial sequence
  specific aptamers
gggagagguguggagaggcg

SEQ ID NO: 4319 - RNA, 20 nt, Artificial sequence
  specific aptamers
gggagagguguggagaggug

SEQ ID NO: 4320 - RNA, 20 nt, Artificial sequence
  specific aptamers
gggagagguguggagcggag

SEQ ID NO: 4321 - RNA, 20 nt, Artificial sequence
  specific aptamers
gggagagguguggagcggcg

SEQ ID NO: 4322 - RNA, 20 nt, Artificial sequence
  specific aptamers
gggagagguguggagcggug

SEQ ID NO: 4323 - RNA, 20 nt, Artificial sequence
  specific aptamers
gggagagguguggaguggag

SEQ ID NO: 4324 - RNA, 20 nt, Artificial sequence
  specific aptamers
gggagagguguggaguggcg

SEQ ID NO: 4325 - RNA, 20 nt, Artificial sequence
  specific aptamers
gggagagguguggaguggug

SEQ ID NO: 4326 - RNA, 21 nt, Artificial sequence
  specific aptamers
gggagaggugugguagaggag

SEQ ID NO: 4327 - RNA, 21 nt, Artificial sequence
  specific aptamers
gggagaggugugguagaggcg

SEQ ID NO: 4328 - RNA, 21 nt, Artificial sequence
  specific aptamers
gggagaggugugguagaggug

SEQ ID NO: 4329 - RNA, 21 nt, Artificial sequence
  specific aptamers
gggagaggugugguagcggag

SEQ ID NO: 4330 - RNA, 21 nt, Artificial sequence
  specific aptamers
gggagaggugugguagcggcg

SEQ ID NO: 4331 - RNA, 21 nt, Artificial sequence
  specific aptamers
gggagaggugugguagcggug

SEQ ID NO: 4332 - RNA, 21 nt, Artificial sequence
  specific aptamers
gggagaggugugguaguggag

SEQ ID NO: 4333 - RNA, 21 nt, Artificial sequence
  specific aptamers
gggagaggugugguaguggcg

SEQ ID NO: 4334 - RNA, 21 nt, Artificial sequence
  specific aptamers
gggagaggugugguaguggug

SEQ ID NO: 4335 - RNA, 21 nt, Artificial sequence
  specific aptamers
gggagaggugugguugaggag

SEQ ID NO: 4336 - RNA, 21 nt, Artificial sequence
  specific aptamers
gggagaggugugguugaggcg

SEQ ID NO: 4337 - RNA, 21 nt, Artificial sequence
  specific aptamers
gggagaggugugguugaggug

SEQ ID NO: 4338 - RNA, 21 nt, Artificial sequence
  specific aptamers
gggagaggugugguugcggag

SEQ ID NO: 4339 - RNA, 21 nt, Artificial sequence
  specific aptamers
gggagaggugugguugcggcg

SEQ ID NO: 4340 - RNA, 21 nt, Artificial sequence
  specific aptamers
gggagaggugugguugcggug

SEQ ID NO: 4341 - RNA, 21 nt, Artificial sequence
  specific aptamers
gggagaggugugguuguggag

SEQ ID NO: 4342 - RNA, 21 nt, Artificial sequence
  specific aptamers
gggagaggugugguuguggcg

SEQ ID NO: 4343 - RNA, 21 nt, Artificial sequence
  specific aptamers
gggagaggugugguuguggug

SEQ ID NO: 4344 - RNA, 20 nt, Artificial sequence
  specific aptamers
gggagagguguggugaggag

SEQ ID NO: 4345 - RNA, 20 nt, Artificial sequence
  specific aptamers
gggagagguguggugaggcg

SEQ ID NO: 4346 - RNA, 20 nt, Artificial sequence
  specific aptamers
gggagagguguggugaggug

SEQ ID NO: 4347 - RNA, 20 nt, Artificial sequence
  specific aptamers
gggagagguguggugcggag

SEQ ID NO: 4348 - RNA, 20 nt, Artificial sequence
  specific aptamers
gggagagguguggugcggcg

SEQ ID NO: 4349 - RNA, 20 nt, Artificial sequence
  specific aptamers
gggagagguguggugcggug

SEQ ID NO: 4350 - RNA, 20 nt, Artificial sequence
  specific aptamers
gggagaggugugguguggag

SEQ ID NO: 4351 - RNA, 20 nt, Artificial sequence
  specific aptamers
gggagaggugugguguggcg

SEQ ID NO: 4352 - RNA, 20 nt, Artificial sequence
  specific aptamers
gggagaggugugguguggug

SEQ ID NO: 4353 - RNA, 21 nt, Artificial sequence
  specific aptamers
gggaguggagaggaagaggag

SEQ ID NO: 4354 - RNA, 21 nt, Artificial sequence
  specific aptamers
gggaguggagaggaagaggcg

SEQ ID NO: 4355 - RNA, 21 nt, Artificial sequence
  specific aptamers
gggaguggagaggaagaggug

SEQ ID NO: 4356 - RNA, 21 nt, Artificial sequence
  specific aptamers
gggaguggagaggaagcggag

SEQ ID NO: 4357 - RNA, 21 nt, Artificial sequence
  specific aptamers
gggaguggagaggaagcggcg

SEQ ID NO: 4358 - RNA, 21 nt, Artificial sequence
  specific aptamers
gggaguggagaggaagcggug

SEQ ID NO: 4359 - RNA, 21 nt, Artificial sequence
  specific aptamers
gggaguggagaggaaguggag

SEQ ID NO: 4360 - RNA, 21 nt, Artificial sequence
  specific aptamers
gggaguggagaggaaguggcg

SEQ ID NO: 4361 - RNA, 21 nt, Artificial sequence
  specific aptamers
gggaguggagaggaaguggug

SEQ ID NO: 4362 - RNA, 21 nt, Artificial sequence
  specific aptamers
gggaguggagaggaugaggag

SEQ ID NO: 4363 - RNA, 21 nt, Artificial sequence
  specific aptamers
gggaguggagaggaugaggcg

SEQ ID NO: 4364 - RNA, 21 nt, Artificial sequence
  specific aptamers
gggaguggagaggaugaggug

SEQ ID NO: 4365 - RNA, 21 nt, Artificial sequence
  specific aptamers
gggaguggagaggaugcggag

SEQ ID NO: 4366 - RNA, 21 nt, Artificial sequence
  specific aptamers
gggaguggagaggaugcggcg

SEQ ID NO: 4367 - RNA, 21 nt, Artificial sequence
  specific aptamers
gggaguggagaggaugcggug

SEQ ID NO: 4368 - RNA, 21 nt, Artificial sequence
  specific aptamers
gggaguggagaggauguggag

SEQ ID NO: 4369 - RNA, 21 nt, Artificial sequence
  specific aptamers
gggaguggagaggauguggcg

SEQ ID NO: 4370 - RNA, 21 nt, Artificial sequence
  specific aptamers
gggaguggagaggauguggug

SEQ ID NO: 4371 - RNA, 20 nt, Artificial sequence
  specific aptamers
gggaguggagaggagaggag

SEQ ID NO: 4372 - RNA, 20 nt, Artificial sequence
  specific aptamers
gggaguggagaggagaggcg

SEQ ID NO: 4373 - RNA, 20 nt, Artificial sequence
  specific aptamers
gggaguggagaggagaggug

SEQ ID NO: 4374 - RNA, 20 nt, Artificial sequence
  specific aptamers
gggaguggagaggagcggag

SEQ ID NO: 4375 - RNA, 20 nt, Artificial sequence
  specific aptamers
gggaguggagaggagcggcg

SEQ ID NO: 4376 - RNA, 20 nt, Artificial sequence
  specific aptamers
gggaguggagaggagcggug

SEQ ID NO: 4377 - RNA, 20 nt, Artificial sequence
  specific aptamers
gggaguggagaggaguggag

SEQ ID NO: 4378 - RNA, 20 nt, Artificial sequence
  specific aptamers
gggaguggagaggaguggcg

SEQ ID NO: 4379 - RNA, 20 nt, Artificial sequence
  specific aptamers
gggaguggagaggaguggug

SEQ ID NO: 4380 - RNA, 21 nt, Artificial sequence
  specific aptamers
gggaguggagagguagaggag

SEQ ID NO: 4381 - RNA, 21 nt, Artificial sequence
  specific aptamers
gggaguggagagguagaggcg

SEQ ID NO: 4382 - RNA, 21 nt, Artificial sequence
  specific aptamers
gggaguggagagguagaggug

SEQ ID NO: 4383 - RNA, 21 nt, Artificial sequence
  specific aptamers
gggaguggagagguagcggag

SEQ ID NO: 4384 - RNA, 21 nt, Artificial sequence
  specific aptamers
gggaguggagagguagcggcg

SEQ ID NO: 4385 - RNA, 21 nt, Artificial sequence
  specific aptamers
gggaguggagagguagcggug

SEQ ID NO: 4386 - RNA, 21 nt, Artificial sequence
  specific aptamers
gggaguggagagguaguggag

SEQ ID NO: 4387 - RNA, 21 nt, Artificial sequence
  specific aptamers
gggaguggagagguaguggcg

SEQ ID NO: 4388 - RNA, 21 nt, Artificial sequence
  specific aptamers
gggaguggagagguaguggug

SEQ ID NO: 4389 - RNA, 21 nt, Artificial sequence
  specific aptamers
gggaguggagagguugaggag

SEQ ID NO: 4390 - RNA, 21 nt, Artificial sequence
  specific aptamers
gggaguggagagguugaggcg

SEQ ID NO: 4391 - RNA, 21 nt, Artificial sequence
  specific aptamers
gggaguggagagguugaggug

SEQ ID NO: 4392 - RNA, 21 nt, Artificial sequence
  specific aptamers
gggaguggagagguugcggag

SEQ ID NO: 4393 - RNA, 21 nt, Artificial sequence
  specific aptamers
gggaguggagagguugcggcg

SEQ ID NO: 4394 - RNA, 21 nt, Artificial sequence
  specific aptamers
gggaguggagagguugcggug

SEQ ID NO: 4395 - RNA, 21 nt, Artificial sequence
  specific aptamers
gggaguggagagguuguggag

SEQ ID NO: 4396 - RNA, 21 nt, Artificial sequence
  specific aptamers
gggaguggagagguuguggcg

SEQ ID NO: 4397 - RNA, 21 nt, Artificial sequence
  specific aptamers
gggaguggagagguuguggug

SEQ ID NO: 4398 - RNA, 20 nt, Artificial sequence
  specific aptamers
gggaguggagaggugaggag

SEQ ID NO: 4399 - RNA, 20 nt, Artificial sequence
  specific aptamers
gggaguggagaggugaggcg

SEQ ID NO: 4400 - RNA, 20 nt, Artificial sequence
  specific aptamers
gggaguggagaggugaggug

SEQ ID NO: 4401 - RNA, 20 nt, Artificial sequence
  specific aptamers
gggaguggagaggugcggag

SEQ ID NO: 4402 - RNA, 20 nt, Artificial sequence
  specific aptamers
gggaguggagaggugcggcg

SEQ ID NO: 4403 - RNA, 20 nt, Artificial sequence
  specific aptamers
gggaguggagaggugcggug

SEQ ID NO: 4404 - RNA, 20 nt, Artificial sequence
  specific aptamers
gggaguggagagguguggag

SEQ ID NO: 4405 - RNA, 20 nt, Artificial sequence
  specific aptamers
gggaguggagagguguggcg

SEQ ID NO: 4406 - RNA, 20 nt, Artificial sequence
  specific aptamers
gggaguggagagguguggug

SEQ ID NO: 4407 - RNA, 21 nt, Artificial sequence
  specific aptamers
gggaguggaguggaagaggag

SEQ ID NO: 4408 - RNA, 21 nt, Artificial sequence
  specific aptamers
gggaguggaguggaagaggcg

SEQ ID NO: 4409 - RNA, 21 nt, Artificial sequence
  specific aptamers
gggaguggaguggaagaggug

SEQ ID NO: 4410 - RNA, 21 nt, Artificial sequence
  specific aptamers
gggaguggaguggaagcggag

SEQ ID NO: 4411 - RNA, 21 nt, Artificial sequence
  specific aptamers
gggaguggaguggaagcggcg

SEQ ID NO: 4412 - RNA, 21 nt, Artificial sequence
  specific aptamers
gggaguggaguggaagcggug

SEQ ID NO: 4413 - RNA, 21 nt, Artificial sequence
  specific aptamers
gggaguggaguggaaguggag

SEQ ID NO: 4414 - RNA, 21 nt, Artificial sequence
  specific aptamers
gggaguggaguggaaguggcg

SEQ ID NO: 4415 - RNA, 21 nt, Artificial sequence
  specific aptamers
gggaguggaguggaaguggug

SEQ ID NO: 4416 - RNA, 21 nt, Artificial sequence
  specific aptamers
gggaguggaguggaugaggag

SEQ ID NO: 4417 - RNA, 21 nt, Artificial sequence
  specific aptamers
gggaguggaguggaugaggcg

SEQ ID NO: 4418 - RNA, 21 nt, Artificial sequence
  specific aptamers
gggaguggaguggaugaggug

SEQ ID NO: 4419 - RNA, 21 nt, Artificial sequence
  specific aptamers
gggaguggaguggaugcggag

SEQ ID NO: 4420 - RNA, 21 nt, Artificial sequence
  specific aptamers
gggaguggaguggaugcggcg

SEQ ID NO: 4421 - RNA, 21 nt, Artificial sequence
  specific aptamers
gggaguggaguggaugcggug

SEQ ID NO: 4422 - RNA, 21 nt, Artificial sequence
  specific aptamers
gggaguggaguggauguggag

SEQ ID NO: 4423 - RNA, 21 nt, Artificial sequence
  specific aptamers
gggaguggaguggauguggcg

SEQ ID NO: 4424 - RNA, 21 nt, Artificial sequence
  specific aptamers
gggaguggaguggauguggug

SEQ ID NO: 4425 - RNA, 20 nt, Artificial sequence
  specific aptamers
gggaguggaguggagaggag

SEQ ID NO: 4426 - RNA, 20 nt, Artificial sequence
  specific aptamers
gggaguggaguggagaggcg

SEQ ID NO: 4427 - RNA, 20 nt, Artificial sequence
  specific aptamers
gggaguggaguggagaggug

SEQ ID NO: 4428 - RNA, 20 nt, Artificial sequence
  specific aptamers
gggaguggaguggagcggag

SEQ ID NO: 4429 - RNA, 20 nt, Artificial sequence
  specific aptamers
gggaguggaguggagcggcg

SEQ ID NO: 4430 - RNA, 20 nt, Artificial sequence
  specific aptamers
gggaguggaguggagcggug

SEQ ID NO: 4431 - RNA, 20 nt, Artificial sequence
  specific aptamers
gggaguggaguggaguggag

SEQ ID NO: 4432 - RNA, 20 nt, Artificial sequence
  specific aptamers
gggaguggaguggaguggcg

SEQ ID NO: 4433 - RNA, 20 nt, Artificial sequence
  specific aptamers
gggaguggaguggaguggug

SEQ ID NO: 4434 - RNA, 21 nt, Artificial sequence
  specific aptamers
gggaguggagugguagaggag

SEQ ID NO: 4435 - RNA, 21 nt, Artificial sequence
  specific aptamers
gggaguggagugguagaggcg

SEQ ID NO: 4436 - RNA, 21 nt, Artificial sequence
  specific aptamers
gggaguggagugguagaggug

SEQ ID NO: 4437 - RNA, 21 nt, Artificial sequence
  specific aptamers
gggaguggagugguagcggag

SEQ ID NO: 4438 - RNA, 21 nt, Artificial sequence
  specific aptamers
gggaguggagugguagcggcg

SEQ ID NO: 4439 - RNA, 21 nt, Artificial sequence
  specific aptamers
gggaguggagugguagcggug

SEQ ID NO: 4440 - RNA, 21 nt, Artificial sequence
  specific aptamers
gggaguggagugguaguggag

SEQ ID NO: 4441 - RNA, 21 nt, Artificial sequence
  specific aptamers
gggaguggagugguaguggcg

SEQ ID NO: 4442 - RNA, 21 nt, Artificial sequence
  specific aptamers
gggaguggagugguaguggug

SEQ ID NO: 4443 - RNA, 21 nt, Artificial sequence
  specific aptamers
gggaguggagugguugaggag

SEQ ID NO: 4444 - RNA, 21 nt, Artificial sequence
  specific aptamers
gggaguggagugguugaggcg

SEQ ID NO: 4445 - RNA, 21 nt, Artificial sequence
  specific aptamers
gggaguggagugguugaggug

SEQ ID NO: 4446 - RNA, 21 nt, Artificial sequence
  specific aptamers
gggaguggagugguugcggag

SEQ ID NO: 4447 - RNA, 21 nt, Artificial sequence
  specific aptamers
gggaguggagugguugcggcg

SEQ ID NO: 4448 - RNA, 21 nt, Artificial sequence
  specific aptamers
gggaguggagugguugcggug

SEQ ID NO: 4449 - RNA, 21 nt, Artificial sequence
  specific aptamers
gggaguggagugguuguggag

SEQ ID NO: 4450 - RNA, 21 nt, Artificial sequence
  specific aptamers
gggaguggagugguuguggcg

SEQ ID NO: 4451 - RNA, 21 nt, Artificial sequence
  specific aptamers
gggaguggagugguuguggug

SEQ ID NO: 4452 - RNA, 20 nt, Artificial sequence
  specific aptamers
gggaguggaguggugaggag

SEQ ID NO: 4453 - RNA, 20 nt, Artificial sequence
  specific aptamers
gggaguggaguggugaggcg

SEQ ID NO: 4454 - RNA, 20 nt, Artificial sequence
  specific aptamers
gggaguggaguggugaggug

SEQ ID NO: 4455 - RNA, 20 nt, Artificial sequence
  specific aptamers
gggaguggaguggugcggag

SEQ ID NO: 4456 - RNA, 20 nt, Artificial sequence
  specific aptamers
gggaguggaguggugcggcg

SEQ ID NO: 4457 - RNA, 20 nt, Artificial sequence
  specific aptamers
gggaguggaguggugcggug

SEQ ID NO: 4458 - RNA, 20 nt, Artificial sequence
  specific aptamers
gggaguggagugguguggag

SEQ ID NO: 4459 - RNA, 20 nt, Artificial sequence
  specific aptamers
gggaguggagugguguggcg

SEQ ID NO: 4460 - RNA, 20 nt, Artificial sequence
  specific aptamers
gggaguggagugguguggug

SEQ ID NO: 4461 - RNA, 21 nt, Artificial sequence
  specific aptamers
gggaguggugaggaagaggag

SEQ ID NO: 4462 - RNA, 21 nt, Artificial sequence
  specific aptamers
gggaguggugaggaagaggcg

SEQ ID NO: 4463 - RNA, 21 nt, Artificial sequence
  specific aptamers
gggaguggugaggaagaggug

SEQ ID NO: 4464 - RNA, 21 nt, Artificial sequence
  specific aptamers
gggaguggugaggaagcggag

SEQ ID NO: 4465 - RNA, 21 nt, Artificial sequence
  specific aptamers
gggaguggugaggaagcggcg

SEQ ID NO: 4466 - RNA, 21 nt, Artificial sequence
  specific aptamers
gggaguggugaggaagcggug

SEQ ID NO: 4467 - RNA, 21 nt, Artificial sequence
  specific aptamers
gggaguggugaggaaguggag

SEQ ID NO: 4468 - RNA, 21 nt, Artificial sequence
  specific aptamers
gggaguggugaggaaguggcg

SEQ ID NO: 4469 - RNA, 21 nt, Artificial sequence
  specific aptamers
gggaguggugaggaaguggug

SEQ ID NO: 4470 - RNA, 21 nt, Artificial sequence
  specific aptamers
gggaguggugaggaugaggag

SEQ ID NO: 4471 - RNA, 21 nt, Artificial sequence
  specific aptamers
gggaguggugaggaugaggcg

SEQ ID NO: 4472 - RNA, 21 nt, Artificial sequence
  specific aptamers
gggaguggugaggaugaggug

SEQ ID NO: 4473 - RNA, 21 nt, Artificial sequence
  specific aptamers
gggaguggugaggaugcggag

SEQ ID NO: 4474 - RNA, 21 nt, Artificial sequence
  specific aptamers
gggaguggugaggaugcggcg

SEQ ID NO: 4475 - RNA, 21 nt, Artificial sequence
  specific aptamers
gggaguggugaggaugcggug

SEQ ID NO: 4476 - RNA, 21 nt, Artificial sequence
  specific aptamers
gggaguggugaggauguggag

SEQ ID NO: 4477 - RNA, 21 nt, Artificial sequence
  specific aptamers
gggaguggugaggauguggcg

SEQ ID NO: 4478 - RNA, 21 nt, Artificial sequence
  specific aptamers
gggaguggugaggauguggug

SEQ ID NO: 4479 - RNA, 20 nt, Artificial sequence
  specific aptamers
gggaguggugaggagaggag

SEQ ID NO: 4480 - RNA, 20 nt, Artificial sequence
  specific aptamers
gggaguggugaggagaggcg

SEQ ID NO: 4481 - RNA, 20 nt, Artificial sequence
  specific aptamers
gggaguggugaggagaggug

SEQ ID NO: 4482 - RNA, 20 nt, Artificial sequence
  specific aptamers
gggaguggugaggagcggag

SEQ ID NO: 4483 - RNA, 20 nt, Artificial sequence
  specific aptamers
gggaguggugaggagcggcg

SEQ ID NO: 4484 - RNA, 20 nt, Artificial sequence
  specific aptamers
gggaguggugaggagcggug

SEQ ID NO: 4485 - RNA, 20 nt, Artificial sequence
  specific aptamers
gggaguggugaggaguggag

SEQ ID NO: 4486 - RNA, 20 nt, Artificial sequence
  specific aptamers
gggaguggugaggaguggcg

SEQ ID NO: 4487 - RNA, 20 nt, Artificial sequence
  specific aptamers
gggaguggugaggaguggug

SEQ ID NO: 4488 - RNA, 21 nt, Artificial sequence
  specific aptamers
gggaguggugagguagaggag

SEQ ID NO: 4489 - RNA, 21 nt, Artificial sequence
  specific aptamers
gggaguggugagguagaggcg

SEQ ID NO: 4490 - RNA, 21 nt, Artificial sequence
  specific aptamers
gggaguggugagguagaggug

SEQ ID NO: 4491 - RNA, 21 nt, Artificial sequence
  specific aptamers
gggaguggugagguagcggag

SEQ ID NO: 4492 - RNA, 21 nt, Artificial sequence
  specific aptamers
gggaguggugagguagcggcg

SEQ ID NO: 4493 - RNA, 21 nt, Artificial sequence
  specific aptamers
gggaguggugagguagcggug

SEQ ID NO: 4494 - RNA, 21 nt, Artificial sequence
  specific aptamers
gggaguggugagguaguggag

SEQ ID NO: 4495 - RNA, 21 nt, Artificial sequence
  specific aptamers
gggaguggugagguaguggcg

SEQ ID NO: 4496 - RNA, 21 nt, Artificial sequence
  specific aptamers
gggaguggugagguaguggug

SEQ ID NO: 4497 - RNA, 21 nt, Artificial sequence
  specific aptamers
gggaguggugagguugaggag

SEQ ID NO: 4498 - RNA, 21 nt, Artificial sequence
  specific aptamers
gggaguggugagguugaggcg

SEQ ID NO: 4499 - RNA, 21 nt, Artificial sequence
  specific aptamers
gggaguggugagguugaggug

SEQ ID NO: 4500 - RNA, 21 nt, Artificial sequence
  specific aptamers
gggaguggugagguugcggag

SEQ ID NO: 4501 - RNA, 21 nt, Artificial sequence
  specific aptamers
gggaguggugagguugcggcg

SEQ ID NO: 4502 - RNA, 21 nt, Artificial sequence
  specific aptamers
gggaguggugagguugcggug

SEQ ID NO: 4503 - RNA, 21 nt, Artificial sequence
  specific aptamers
gggaguggugagguuguggag

SEQ ID NO: 4504 - RNA, 21 nt, Artificial sequence
  specific aptamers
gggaguggugagguuguggcg

SEQ ID NO: 4505 - RNA, 21 nt, Artificial sequence
  specific aptamers
gggaguggugagguuguggug

SEQ ID NO: 4506 - RNA, 20 nt, Artificial sequence
  specific aptamers
gggaguggugaggugaggag

SEQ ID NO: 4507 - RNA, 20 nt, Artificial sequence
  specific aptamers
gggaguggugaggugaggcg

SEQ ID NO: 4508 - RNA, 20 nt, Artificial sequence
  specific aptamers
gggaguggugaggugaggug

SEQ ID NO: 4509 - RNA, 20 nt, Artificial sequence
  specific aptamers
gggaguggugaggugcggag

SEQ ID NO: 4510 - RNA, 20 nt, Artificial sequence
  specific aptamers
gggaguggugaggugcggcg

SEQ ID NO: 4511 - RNA, 20 nt, Artificial sequence
  specific aptamers
gggaguggugaggugcggug

SEQ ID NO: 4512 - RNA, 20 nt, Artificial sequence
  specific aptamers
gggaguggugagguguggag

SEQ ID NO: 4513 - RNA, 20 nt, Artificial sequence
  specific aptamers
gggaguggugagguguggcg

SEQ ID NO: 4514 - RNA, 20 nt, Artificial sequence
  specific aptamers
gggaguggugagguguggug

SEQ ID NO: 4515 - RNA, 21 nt, Artificial sequence
  specific aptamers
gggagugguguggaagaggag

SEQ ID NO: 4516 - RNA, 21 nt, Artificial sequence
  specific aptamers
gggagugguguggaagaggcg

SEQ ID NO: 4517 - RNA, 21 nt, Artificial sequence
  specific aptamers
gggagugguguggaagaggug

SEQ ID NO: 4518 - RNA, 21 nt, Artificial sequence
  specific aptamers
gggagugguguggaagcggag

SEQ ID NO: 4519 - RNA, 21 nt, Artificial sequence
  specific aptamers
gggagugguguggaagcggcg

SEQ ID NO: 4520 - RNA, 21 nt, Artificial sequence
  specific aptamers
gggagugguguggaagcggug

SEQ ID NO: 4521 - RNA, 21 nt, Artificial sequence
  specific aptamers
gggagugguguggaaguggag

SEQ ID NO: 4522 - RNA, 21 nt, Artificial sequence
  specific aptamers
gggagugguguggaaguggcg

SEQ ID NO: 4523 - RNA, 21 nt, Artificial sequence
  specific aptamers
gggagugguguggaaguggug

SEQ ID NO: 4524 - RNA, 21 nt, Artificial sequence
  specific aptamers
gggagugguguggaugaggag

SEQ ID NO: 4525 - RNA, 21 nt, Artificial sequence
  specific aptamers
gggagugguguggaugaggcg

SEQ ID NO: 4526 - RNA, 21 nt, Artificial sequence
  specific aptamers
gggagugguguggaugaggug

SEQ ID NO: 4527 - RNA, 21 nt, Artificial sequence
  specific aptamers
gggagugguguggaugcggag

SEQ ID NO: 4528 - RNA, 21 nt, Artificial sequence
  specific aptamers
gggagugguguggaugcggcg

SEQ ID NO: 4529 - RNA, 21 nt, Artificial sequence
  specific aptamers
gggagugguguggaugcggug

SEQ ID NO: 4530 - RNA, 21 nt, Artificial sequence
  specific aptamers
gggagugguguggauguggag

SEQ ID NO: 4531 - RNA, 21 nt, Artificial sequence
  specific aptamers
gggagugguguggauguggcg

SEQ ID NO: 4532 - RNA, 21 nt, Artificial sequence
  specific aptamers
gggagugguguggauguggug

SEQ ID NO: 4533 - RNA, 20 nt, Artificial sequence
  specific aptamers
gggagugguguggagaggag

SEQ ID NO: 4534 - RNA, 20 nt, Artificial sequence
  specific aptamers
gggagugguguggagaggcg

SEQ ID NO: 4535 - RNA, 20 nt, Artificial sequence
  specific aptamers
gggagugguguggagaggug

SEQ ID NO: 4536 - RNA, 20 nt, Artificial sequence
  specific aptamers
gggagugguguggagcggag

SEQ ID NO: 4537 - RNA, 20 nt, Artificial sequence
  specific aptamers
gggagugguguggagcggcg

SEQ ID NO: 4538 - RNA, 20 nt, Artificial sequence
  specific aptamers
gggagugguguggagcggug

SEQ ID NO: 4539 - RNA, 20 nt, Artificial sequence
  specific aptamers
gggagugguguggaguggag

SEQ ID NO: 4540 - RNA, 20 nt, Artificial sequence
  specific aptamers
gggagugguguggaguggcg

SEQ ID NO: 4541 - RNA, 20 nt, Artificial sequence
  specific aptamers
gggagugguguggaguggug

SEQ ID NO: 4542 - RNA, 21 nt, Artificial sequence
  specific aptamers
gggaguggugugguagaggag

SEQ ID NO: 4543 - RNA, 21 nt, Artificial sequence
  specific aptamers
gggaguggugugguagaggcg

SEQ ID NO: 4544 - RNA, 21 nt, Artificial sequence
  specific aptamers
gggaguggugugguagaggug

SEQ ID NO: 4545 - RNA, 21 nt, Artificial sequence
  specific aptamers
gggaguggugugguagcggag

SEQ ID NO: 4546 - RNA, 21 nt, Artificial sequence
  specific aptamers
gggaguggugugguagcggcg

SEQ ID NO: 4547 - RNA, 21 nt, Artificial sequence
  specific aptamers
gggaguggugugguagcggug

SEQ ID NO: 4548 - RNA, 21 nt, Artificial sequence
  specific aptamers
gggaguggugugguaguggag

SEQ ID NO: 4549 - RNA, 21 nt, Artificial sequence
  specific aptamers
gggaguggugugguaguggcg

SEQ ID NO: 4550 - RNA, 21 nt, Artificial sequence
  specific aptamers
gggaguggugugguaguggug

SEQ ID NO: 4551 - RNA, 21 nt, Artificial sequence
  specific aptamers
gggaguggugugguugaggag

SEQ ID NO: 4552 - RNA, 21 nt, Artificial sequence
  specific aptamers
gggaguggugugguugaggcg

SEQ ID NO: 4553 - RNA, 21 nt, Artificial sequence
  specific aptamers
gggaguggugugguugaggug

SEQ ID NO: 4554 - RNA, 21 nt, Artificial sequence
  specific aptamers
gggaguggugugguugcggag

SEQ ID NO: 4555 - RNA, 21 nt, Artificial sequence
  specific aptamers
gggaguggugugguugcggcg

SEQ ID NO: 4556 - RNA, 21 nt, Artificial sequence
  specific aptamers
gggaguggugugguugcggug

SEQ ID NO: 4557 - RNA, 21 nt, Artificial sequence
  specific aptamers
gggaguggugugguuguggag

SEQ ID NO: 4558 - RNA, 21 nt, Artificial sequence
  specific aptamers
gggaguggugugguuguggcg

SEQ ID NO: 4559 - RNA, 21 nt, Artificial sequence
  specific aptamers
gggaguggugugguuguggug

SEQ ID NO: 4560 - RNA, 20 nt, Artificial sequence
  specific aptamers
gggagugguguggugaggag

SEQ ID NO: 4561 - RNA, 20 nt, Artificial sequence
  specific aptamers
gggagugguguggugaggcg

SEQ ID NO: 4562 - RNA, 20 nt, Artificial sequence
  specific aptamers
gggagugguguggugaggug

SEQ ID NO: 4563 - RNA, 20 nt, Artificial sequence
  specific aptamers
gggagugguguggugcggag

SEQ ID NO: 4564 - RNA, 20 nt, Artificial sequence
  specific aptamers
gggagugguguggugcggcg

SEQ ID NO: 4565 - RNA, 20 nt, Artificial sequence
  specific aptamers
gggagugguguggugcggug

SEQ ID NO: 4566 - RNA, 20 nt, Artificial sequence
  specific aptamers
gggaguggugugguguggag

SEQ ID NO: 4567 - RNA, 20 nt, Artificial sequence
  specific aptamers
gggaguggugugguguggcg

SEQ ID NO: 4568 - RNA, 20 nt, Artificial sequence
  specific aptamers
gggaguggugugguguggug

SEQ ID NO: 4569 - RNA, 21 nt, Artificial sequence
  specific aptamers
gggugaggagaggaagaggag

SEQ ID NO: 4570 - RNA, 21 nt, Artificial sequence
  specific aptamers
gggugaggagaggaagaggcg

SEQ ID NO: 4571 - RNA, 21 nt, Artificial sequence
  specific aptamers
gggugaggagaggaagaggug

SEQ ID NO: 4572 - RNA, 21 nt, Artificial sequence
  specific aptamers
gggugaggagaggaagcggag

SEQ ID NO: 4573 - RNA, 21 nt, Artificial sequence
  specific aptamers
gggugaggagaggaagcggcg

SEQ ID NO: 4574 - RNA, 21 nt, Artificial sequence
  specific aptamers
gggugaggagaggaagcggug

SEQ ID NO: 4575 - RNA, 21 nt, Artificial sequence
  specific aptamers
gggugaggagaggaaguggag

SEQ ID NO: 4576 - RNA, 21 nt, Artificial sequence
  specific aptamers
gggugaggagaggaaguggcg

SEQ ID NO: 4577 - RNA, 21 nt, Artificial sequence
  specific aptamers
gggugaggagaggaaguggug

SEQ ID NO: 4578 - RNA, 21 nt, Artificial sequence
  specific aptamers
gggugaggagaggaugaggag

SEQ ID NO: 4579 - RNA, 21 nt, Artificial sequence
  specific aptamers
gggugaggagaggaugaggcg

SEQ ID NO: 4580 - RNA, 21 nt, Artificial sequence
  specific aptamers
gggugaggagaggaugaggug

SEQ ID NO: 4581 - RNA, 21 nt, Artificial sequence
  specific aptamers
gggugaggagaggaugcggag

SEQ ID NO: 4582 - RNA, 21 nt, Artificial sequence
  specific aptamers
gggugaggagaggaugcggcg

SEQ ID NO: 4583 - RNA, 21 nt, Artificial sequence
  specific aptamers
gggugaggagaggaugcggug

SEQ ID NO: 4584 - RNA, 21 nt, Artificial sequence
  specific aptamers
gggugaggagaggauguggag

SEQ ID NO: 4585 - RNA, 21 nt, Artificial sequence
  specific aptamers
gggugaggagaggauguggcg

SEQ ID NO: 4586 - RNA, 21 nt, Artificial sequence
  specific aptamers
gggugaggagaggauguggug

SEQ ID NO: 4587 - RNA, 20 nt, Artificial sequence
  specific aptamers
gggugaggagaggagaggag

SEQ ID NO: 4588 - RNA, 20 nt, Artificial sequence
  specific aptamers
gggugaggagaggagaggcg

SEQ ID NO: 4589 - RNA, 20 nt, Artificial sequence
  specific aptamers
gggugaggagaggagaggug

SEQ ID NO: 4590 - RNA, 20 nt, Artificial sequence
  specific aptamers
gggugaggagaggagcggag

SEQ ID NO: 4591 - RNA, 20 nt, Artificial sequence
  specific aptamers
gggugaggagaggagcggcg

SEQ ID NO: 4592 - RNA, 20 nt, Artificial sequence
  specific aptamers
gggugaggagaggagcggug

SEQ ID NO: 4593 - RNA, 20 nt, Artificial sequence
  specific aptamers
gggugaggagaggaguggag

SEQ ID NO: 4594 - RNA, 20 nt, Artificial sequence
  specific aptamers
gggugaggagaggaguggcg

SEQ ID NO: 4595 - RNA, 20 nt, Artificial sequence
  specific aptamers
gggugaggagaggaguggug

SEQ ID NO: 4596 - RNA, 21 nt, Artificial sequence
  specific aptamers
gggugaggagagguagaggag

SEQ ID NO: 4597 - RNA, 21 nt, Artificial sequence
  specific aptamers
gggugaggagagguagaggcg

SEQ ID NO: 4598 - RNA, 21 nt, Artificial sequence
  specific aptamers
gggugaggagagguagaggug

SEQ ID NO: 4599 - RNA, 21 nt, Artificial sequence
  specific aptamers
gggugaggagagguagcggag

SEQ ID NO: 4600 - RNA, 21 nt, Artificial sequence
  specific aptamers
gggugaggagagguagcggcg

SEQ ID NO: 4601 - RNA, 21 nt, Artificial sequence
  specific aptamers
gggugaggagagguagcggug

SEQ ID NO: 4602 - RNA, 21 nt, Artificial sequence
  specific aptamers
gggugaggagagguaguggag

SEQ ID NO: 4603 - RNA, 21 nt, Artificial sequence
  specific aptamers
gggugaggagagguaguggcg

SEQ ID NO: 4604 - RNA, 21 nt, Artificial sequence
  specific aptamers
gggugaggagagguaguggug

SEQ ID NO: 4605 - RNA, 21 nt, Artificial sequence
  specific aptamers
gggugaggagagguugaggag

SEQ ID NO: 4606 - RNA, 21 nt, Artificial sequence
  specific aptamers
gggugaggagagguugaggcg

SEQ ID NO: 4607 - RNA, 21 nt, Artificial sequence
  specific aptamers
gggugaggagagguugaggug

SEQ ID NO: 4608 - RNA, 21 nt, Artificial sequence
  specific aptamers
gggugaggagagguugcggag

SEQ ID NO: 4609 - RNA, 21 nt, Artificial sequence
  specific aptamers
gggugaggagagguugcggcg

SEQ ID NO: 4610 - RNA, 21 nt, Artificial sequence
  specific aptamers
gggugaggagagguugcggug

SEQ ID NO: 4611 - RNA, 21 nt, Artificial sequence
  specific aptamers
gggugaggagagguuguggag

SEQ ID NO: 4612 - RNA, 21 nt, Artificial sequence
  specific aptamers
gggugaggagagguuguggcg

SEQ ID NO: 4613 - RNA, 21 nt, Artificial sequence
  specific aptamers
gggugaggagagguuguggug

SEQ ID NO: 4614 - RNA, 20 nt, Artificial sequence
  specific aptamers
gggugaggagaggugaggag

SEQ ID NO: 4615 - RNA, 20 nt, Artificial sequence
  specific aptamers
gggugaggagaggugaggcg

SEQ ID NO: 4616 - RNA, 20 nt, Artificial sequence
  specific aptamers
gggugaggagaggugaggug

SEQ ID NO: 4617 - RNA, 20 nt, Artificial sequence
  specific aptamers
gggugaggagaggugcggag

SEQ ID NO: 4618 - RNA, 20 nt, Artificial sequence
  specific aptamers
gggugaggagaggugcggcg

SEQ ID NO: 4619 - RNA, 20 nt, Artificial sequence
  specific aptamers
gggugaggagaggugcggug

SEQ ID NO: 4620 - RNA, 20 nt, Artificial sequence
  specific aptamers
gggugaggagagguguggag

SEQ ID NO: 4621 - RNA, 20 nt, Artificial sequence
  specific aptamers
gggugaggagagguguggcg

SEQ ID NO: 4622 - RNA, 20 nt, Artificial sequence
  specific aptamers
gggugaggagagguguggug

SEQ ID NO: 4623 - RNA, 21 nt, Artificial sequence
  specific aptamers
gggugaggaguggaagaggag

SEQ ID NO: 4624 - RNA, 21 nt, Artificial sequence
  specific aptamers
gggugaggaguggaagaggcg

SEQ ID NO: 4625 - RNA, 21 nt, Artificial sequence
  specific aptamers
gggugaggaguggaagaggug

SEQ ID NO: 4626 - RNA, 21 nt, Artificial sequence
  specific aptamers
gggugaggaguggaagcggag

SEQ ID NO: 4627 - RNA, 21 nt, Artificial sequence
  specific aptamers
gggugaggaguggaagcggcg

SEQ ID NO: 4628 - RNA, 21 nt, Artificial sequence
  specific aptamers
gggugaggaguggaagcggug

SEQ ID NO: 4629 - RNA, 21 nt, Artificial sequence
  specific aptamers
gggugaggaguggaaguggag

SEQ ID NO: 4630 - RNA, 21 nt, Artificial sequence
  specific aptamers
gggugaggaguggaaguggcg

SEQ ID NO: 4631 - RNA, 21 nt, Artificial sequence
  specific aptamers
gggugaggaguggaaguggug

SEQ ID NO: 4632 - RNA, 21 nt, Artificial sequence
  specific aptamers
gggugaggaguggaugaggag

SEQ ID NO: 4633 - RNA, 21 nt, Artificial sequence
  specific aptamers
gggugaggaguggaugaggcg

SEQ ID NO: 4634 - RNA, 21 nt, Artificial sequence
  specific aptamers
gggugaggaguggaugaggug

SEQ ID NO: 4635 - RNA, 21 nt, Artificial sequence
  specific aptamers
gggugaggaguggaugcggag

SEQ ID NO: 4636 - RNA, 21 nt, Artificial sequence
  specific aptamers
gggugaggaguggaugcggcg

SEQ ID NO: 4637 - RNA, 21 nt, Artificial sequence
  specific aptamers
gggugaggaguggaugcggug

SEQ ID NO: 4638 - RNA, 21 nt, Artificial sequence
  specific aptamers
gggugaggaguggauguggag

SEQ ID NO: 4639 - RNA, 21 nt, Artificial sequence
  specific aptamers
gggugaggaguggauguggcg

SEQ ID NO: 4640 - RNA, 21 nt, Artificial sequence
  specific aptamers
gggugaggaguggauguggug

SEQ ID NO: 4641 - RNA, 20 nt, Artificial sequence
  specific aptamers
gggugaggaguggagaggag

SEQ ID NO: 4642 - RNA, 20 nt, Artificial sequence
  specific aptamers
gggugaggaguggagaggcg

SEQ ID NO: 4643 - RNA, 20 nt, Artificial sequence
  specific aptamers
gggugaggaguggagaggug

SEQ ID NO: 4644 - RNA, 20 nt, Artificial sequence
  specific aptamers
gggugaggaguggagcggag

SEQ ID NO: 4645 - RNA, 20 nt, Artificial sequence
  specific aptamers
gggugaggaguggagcggcg

SEQ ID NO: 4646 - RNA, 20 nt, Artificial sequence
  specific aptamers
gggugaggaguggagcggug

SEQ ID NO: 4647 - RNA, 20 nt, Artificial sequence
  specific aptamers
gggugaggaguggaguggag

SEQ ID NO: 4648 - RNA, 20 nt, Artificial sequence
  specific aptamers
gggugaggaguggaguggcg

SEQ ID NO: 4649 - RNA, 20 nt, Artificial sequence
  specific aptamers
gggugaggaguggaguggug

SEQ ID NO: 4650 - RNA, 21 nt, Artificial sequence
  specific aptamers
gggugaggagugguagaggag

SEQ ID NO: 4651 - RNA, 21 nt, Artificial sequence
  specific aptamers
gggugaggagugguagaggcg

SEQ ID NO: 4652 - RNA, 21 nt, Artificial sequence
  specific aptamers
gggugaggagugguagaggug

SEQ ID NO: 4653 - RNA, 21 nt, Artificial sequence
  specific aptamers
gggugaggagugguagcggag

SEQ ID NO: 4654 - RNA, 21 nt, Artificial sequence
  specific aptamers
gggugaggagugguagcggcg

SEQ ID NO: 4655 - RNA, 21 nt, Artificial sequence
  specific aptamers
gggugaggagugguagcggug

SEQ ID NO: 4656 - RNA, 21 nt, Artificial sequence
  specific aptamers
gggugaggagugguaguggag

SEQ ID NO: 4657 - RNA, 21 nt, Artificial sequence
  specific aptamers
gggugaggagugguaguggcg

SEQ ID NO: 4658 - RNA, 21 nt, Artificial sequence
  specific aptamers
gggugaggagugguaguggug

SEQ ID NO: 4659 - RNA, 21 nt, Artificial sequence
  specific aptamers
gggugaggagugguugaggag

SEQ ID NO: 4660 - RNA, 21 nt, Artificial sequence
  specific aptamers
gggugaggagugguugaggcg

SEQ ID NO: 4661 - RNA, 21 nt, Artificial sequence
  specific aptamers
gggugaggagugguugaggug

SEQ ID NO: 4662 - RNA, 21 nt, Artificial sequence
  specific aptamers
gggugaggagugguugcggag

SEQ ID NO: 4663 - RNA, 21 nt, Artificial sequence
  specific aptamers
gggugaggagugguugcggcg

SEQ ID NO: 4664 - RNA, 21 nt, Artificial sequence
  specific aptamers
gggugaggagugguugcggug

SEQ ID NO: 4665 - RNA, 21 nt, Artificial sequence
  specific aptamers
gggugaggagugguuguggag

SEQ ID NO: 4666 - RNA, 21 nt, Artificial sequence
  specific aptamers
gggugaggagugguuguggcg

SEQ ID NO: 4667 - RNA, 21 nt, Artificial sequence
  specific aptamers
gggugaggagugguuguggug

SEQ ID NO: 4668 - RNA, 20 nt, Artificial sequence
  specific aptamers
gggugaggaguggugaggag

SEQ ID NO: 4669 - RNA, 20 nt, Artificial sequence
  specific aptamers
gggugaggaguggugaggcg

SEQ ID NO: 4670 - RNA, 20 nt, Artificial sequence
  specific aptamers
gggugaggaguggugaggug

SEQ ID NO: 4671 - RNA, 20 nt, Artificial sequence
  specific aptamers
gggugaggaguggugcggag

SEQ ID NO: 4672 - RNA, 20 nt, Artificial sequence
  specific aptamers
gggugaggaguggugcggcg

SEQ ID NO: 4673 - RNA, 20 nt, Artificial sequence
  specific aptamers
gggugaggaguggugcggug

SEQ ID NO: 4674 - RNA, 20 nt, Artificial sequence
  specific aptamers
gggugaggagugguguggag

SEQ ID NO: 4675 - RNA, 20 nt, Artificial sequence
  specific aptamers
gggugaggagugguguggcg

SEQ ID NO: 4676 - RNA, 20 nt, Artificial sequence
  specific aptamers
gggugaggagugguguggug

SEQ ID NO: 4677 - RNA, 21 nt, Artificial sequence
  specific aptamers
gggugaggugaggaagaggag

SEQ ID NO: 4678 - RNA, 21 nt, Artificial sequence
  specific aptamers
gggugaggugaggaagaggcg

SEQ ID NO: 4679 - RNA, 21 nt, Artificial sequence
  specific aptamers
gggugaggugaggaagaggug

SEQ ID NO: 4680 - RNA, 21 nt, Artificial sequence
  specific aptamers
gggugaggugaggaagcggag

SEQ ID NO: 4681 - RNA, 21 nt, Artificial sequence
  specific aptamers
gggugaggugaggaagcggcg

SEQ ID NO: 4682 - RNA, 21 nt, Artificial sequence
  specific aptamers
gggugaggugaggaagcggug

SEQ ID NO: 4683 - RNA, 21 nt, Artificial sequence
  specific aptamers
gggugaggugaggaaguggag

SEQ ID NO: 4684 - RNA, 21 nt, Artificial sequence
  specific aptamers
gggugaggugaggaaguggcg

SEQ ID NO: 4685 - RNA, 21 nt, Artificial sequence
  specific aptamers
gggugaggugaggaaguggug

SEQ ID NO: 4686 - RNA, 21 nt, Artificial sequence
  specific aptamers
gggugaggugaggaugaggag

SEQ ID NO: 4687 - RNA, 21 nt, Artificial sequence
  specific aptamers
gggugaggugaggaugaggcg

SEQ ID NO: 4688 - RNA, 21 nt, Artificial sequence
  specific aptamers
gggugaggugaggaugaggug

SEQ ID NO: 4689 - RNA, 21 nt, Artificial sequence
  specific aptamers
gggugaggugaggaugcggag

SEQ ID NO: 4690 - RNA, 21 nt, Artificial sequence
  specific aptamers
gggugaggugaggaugcggcg

SEQ ID NO: 4691 - RNA, 21 nt, Artificial sequence
  specific aptamers
gggugaggugaggaugcggug

SEQ ID NO: 4692 - RNA, 21 nt, Artificial sequence
  specific aptamers
gggugaggugaggauguggag

SEQ ID NO: 4693 - RNA, 21 nt, Artificial sequence
  specific aptamers
gggugaggugaggauguggcg

SEQ ID NO: 4694 - RNA, 21 nt, Artificial sequence
  specific aptamers
gggugaggugaggauguggug

SEQ ID NO: 4695 - RNA, 20 nt, Artificial sequence
  specific aptamers
gggugaggugaggagaggag

SEQ ID NO: 4696 - RNA, 20 nt, Artificial sequence
  specific aptamers
gggugaggugaggagaggcg

SEQ ID NO: 4697 - RNA, 20 nt, Artificial sequence
  specific aptamers
gggugaggugaggagaggug

SEQ ID NO: 4698 - RNA, 20 nt, Artificial sequence
  specific aptamers
gggugaggugaggagcggag

SEQ ID NO: 4699 - RNA, 20 nt, Artificial sequence
  specific aptamers
gggugaggugaggagcggcg

SEQ ID NO: 4700 - RNA, 20 nt, Artificial sequence
  specific aptamers
gggugaggugaggagcggug

SEQ ID NO: 4701 - RNA, 20 nt, Artificial sequence
  specific aptamers
gggugaggugaggaguggag

SEQ ID NO: 4702 - RNA, 20 nt, Artificial sequence
  specific aptamers
gggugaggugaggaguggcg

SEQ ID NO: 4703 - RNA, 20 nt, Artificial sequence
  specific aptamers
gggugaggugaggaguggug

SEQ ID NO: 4704 - RNA, 21 nt, Artificial sequence
  specific aptamers
gggugaggugagguagaggag

SEQ ID NO: 4705 - RNA, 21 nt, Artificial sequence
  specific aptamers
gggugaggugagguagaggcg

SEQ ID NO: 4706 - RNA, 21 nt, Artificial sequence
  specific aptamers
gggugaggugagguagaggug

SEQ ID NO: 4707 - RNA, 21 nt, Artificial sequence
  specific aptamers
gggugaggugagguagcggag

SEQ ID NO: 4708 - RNA, 21 nt, Artificial sequence
  specific aptamers
gggugaggugagguagcggcg

SEQ ID NO: 4709 - RNA, 21 nt, Artificial sequence
  specific aptamers
gggugaggugagguagcggug

SEQ ID NO: 4710 - RNA, 21 nt, Artificial sequence
  specific aptamers
gggugaggugagguaguggag

SEQ ID NO: 4711 - RNA, 21 nt, Artificial sequence
  specific aptamers
gggugaggugagguaguggcg

SEQ ID NO: 4712 - RNA, 21 nt, Artificial sequence
  specific aptamers
gggugaggugagguaguggug

SEQ ID NO: 4713 - RNA, 21 nt, Artificial sequence
  specific aptamers
gggugaggugagguugaggag

SEQ ID NO: 4714 - RNA, 21 nt, Artificial sequence
  specific aptamers
gggugaggugagguugaggcg

SEQ ID NO: 4715 - RNA, 21 nt, Artificial sequence
  specific aptamers
gggugaggugagguugaggug

SEQ ID NO: 4716 - RNA, 21 nt, Artificial sequence
  specific aptamers
gggugaggugagguugcggag

SEQ ID NO: 4717 - RNA, 21 nt, Artificial sequence
  specific aptamers
gggugaggugagguugcggcg

SEQ ID NO: 4718 - RNA, 21 nt, Artificial sequence
  specific aptamers
gggugaggugagguugcggug

SEQ ID NO: 4719 - RNA, 21 nt, Artificial sequence
  specific aptamers
gggugaggugagguuguggag

SEQ ID NO: 4720 - RNA, 21 nt, Artificial sequence
  specific aptamers
gggugaggugagguuguggcg

SEQ ID NO: 4721 - RNA, 21 nt, Artificial sequence
  specific aptamers
gggugaggugagguuguggug

SEQ ID NO: 4722 - RNA, 20 nt, Artificial sequence
  specific aptamers
gggugaggugaggugaggag

SEQ ID NO: 4723 - RNA, 20 nt, Artificial sequence
  specific aptamers
gggugaggugaggugaggcg

SEQ ID NO: 4724 - RNA, 20 nt, Artificial sequence
  specific aptamers
gggugaggugaggugaggug

SEQ ID NO: 4725 - RNA, 20 nt, Artificial sequence
  specific aptamers
gggugaggugaggugcggag

SEQ ID NO: 4726 - RNA, 20 nt, Artificial sequence
  specific aptamers
gggugaggugaggugcggcg

SEQ ID NO: 4727 - RNA, 20 nt, Artificial sequence
  specific aptamers
gggugaggugaggugcggug

SEQ ID NO: 4728 - RNA, 20 nt, Artificial sequence
  specific aptamers
gggugaggugagguguggag

SEQ ID NO: 4729 - RNA, 20 nt, Artificial sequence
  specific aptamers
gggugaggugagguguggcg

SEQ ID NO: 4730 - RNA, 20 nt, Artificial sequence
  specific aptamers
gggugaggugagguguggug

SEQ ID NO: 4731 - RNA, 21 nt, Artificial sequence
  specific aptamers
gggugagguguggaagaggag

SEQ ID NO: 4732 - RNA, 21 nt, Artificial sequence
  specific aptamers
gggugagguguggaagaggcg

SEQ ID NO: 4733 - RNA, 21 nt, Artificial sequence
  specific aptamers
gggugagguguggaagaggug

SEQ ID NO: 4734 - RNA, 21 nt, Artificial sequence
  specific aptamers
gggugagguguggaagcggag

SEQ ID NO: 4735 - RNA, 21 nt, Artificial sequence
  specific aptamers
gggugagguguggaagcggcg

SEQ ID NO: 4736 - RNA, 21 nt, Artificial sequence
  specific aptamers
gggugagguguggaagcggug

SEQ ID NO: 4737 - RNA, 21 nt, Artificial sequence
  specific aptamers
gggugagguguggaaguggag

SEQ ID NO: 4738 - RNA, 21 nt, Artificial sequence
  specific aptamers
gggugagguguggaaguggcg

SEQ ID NO: 4739 - RNA, 21 nt, Artificial sequence
  specific aptamers
gggugagguguggaaguggug

SEQ ID NO: 4740 - RNA, 21 nt, Artificial sequence
  specific aptamers
gggugagguguggaugaggag

SEQ ID NO: 4741 - RNA, 21 nt, Artificial sequence
  specific aptamers
gggugagguguggaugaggcg

SEQ ID NO: 4742 - RNA, 21 nt, Artificial sequence
  specific aptamers
gggugagguguggaugaggug

SEQ ID NO: 4743 - RNA, 21 nt, Artificial sequence
  specific aptamers
gggugagguguggaugcggag

SEQ ID NO: 4744 - RNA, 21 nt, Artificial sequence
  specific aptamers
gggugagguguggaugcggcg

SEQ ID NO: 4745 - RNA, 21 nt, Artificial sequence
  specific aptamers
gggugagguguggaugcggug

SEQ ID NO: 4746 - RNA, 21 nt, Artificial sequence
  specific aptamers
gggugagguguggauguggag

SEQ ID NO: 4747 - RNA, 21 nt, Artificial sequence
  specific aptamers
gggugagguguggauguggcg

SEQ ID NO: 4748 - RNA, 21 nt, Artificial sequence
  specific aptamers
gggugagguguggauguggug

SEQ ID NO: 4749 - RNA, 20 nt, Artificial sequence
  specific aptamers
gggugagguguggagaggag

SEQ ID NO: 4750 - RNA, 20 nt, Artificial sequence
  specific aptamers
gggugagguguggagaggcg

SEQ ID NO: 4751 - RNA, 20 nt, Artificial sequence
  specific aptamers
gggugagguguggagaggug

SEQ ID NO: 4752 - RNA, 20 nt, Artificial sequence
  specific aptamers
gggugagguguggagcggag

SEQ ID NO: 4753 - RNA, 20 nt, Artificial sequence
  specific aptamers
gggugagguguggagcggcg

SEQ ID NO: 4754 - RNA, 20 nt, Artificial sequence
  specific aptamers
gggugagguguggagcggug

SEQ ID NO: 4755 - RNA, 20 nt, Artificial sequence
  specific aptamers
gggugagguguggaguggag

SEQ ID NO: 4756 - RNA, 20 nt, Artificial sequence
  specific aptamers
gggugagguguggaguggcg

SEQ ID NO: 4757 - RNA, 20 nt, Artificial sequence
  specific aptamers
gggugagguguggaguggug

SEQ ID NO: 4758 - RNA, 21 nt, Artificial sequence
  specific aptamers
gggugaggugugguagaggag

SEQ ID NO: 4759 - RNA, 21 nt, Artificial sequence
  specific aptamers
gggugaggugugguagaggcg

SEQ ID NO: 4760 - RNA, 21 nt, Artificial sequence
  specific aptamers
gggugaggugugguagaggug

SEQ ID NO: 4761 - RNA, 21 nt, Artificial sequence
  specific aptamers
gggugaggugugguagcggag

SEQ ID NO: 4762 - RNA, 21 nt, Artificial sequence
  specific aptamers
gggugaggugugguagcggcg

SEQ ID NO: 4763 - RNA, 21 nt, Artificial sequence
  specific aptamers
gggugaggugugguagcggug

SEQ ID NO: 4764 - RNA, 21 nt, Artificial sequence
  specific aptamers
gggugaggugugguaguggag

SEQ ID NO: 4765 - RNA, 21 nt, Artificial sequence
  specific aptamers
gggugaggugugguaguggcg

SEQ ID NO: 4766 - RNA, 21 nt, Artificial sequence
  specific aptamers
gggugaggugugguaguggug

SEQ ID NO: 4767 - RNA, 21 nt, Artificial sequence
  specific aptamers
gggugaggugugguugaggag

SEQ ID NO: 4768 - RNA, 21 nt, Artificial sequence
  specific aptamers
gggugaggugugguugaggcg

SEQ ID NO: 4769 - RNA, 21 nt, Artificial sequence
  specific aptamers
gggugaggugugguugaggug

SEQ ID NO: 4770 - RNA, 21 nt, Artificial sequence
  specific aptamers
gggugaggugugguugcggag

SEQ ID NO: 4771 - RNA, 21 nt, Artificial sequence
  specific aptamers
gggugaggugugguugcggcg

SEQ ID NO: 4772 - RNA, 21 nt, Artificial sequence
  specific aptamers
gggugaggugugguugcggug

SEQ ID NO: 4773 - RNA, 21 nt, Artificial sequence
  specific aptamers
gggugaggugugguuguggag

SEQ ID NO: 4774 - RNA, 21 nt, Artificial sequence
  specific aptamers
gggugaggugugguuguggcg

SEQ ID NO: 4775 - RNA, 21 nt, Artificial sequence
  specific aptamers
gggugaggugugguuguggug

SEQ ID NO: 4776 - RNA, 20 nt, Artificial sequence
  specific aptamers
gggugagguguggugaggag

SEQ ID NO: 4777 - RNA, 20 nt, Artificial sequence
  specific aptamers
gggugagguguggugaggcg

SEQ ID NO: 4778 - RNA, 20 nt, Artificial sequence
  specific aptamers
gggugagguguggugaggug

SEQ ID NO: 4779 - RNA, 20 nt, Artificial sequence
  specific aptamers
gggugagguguggugcggag

SEQ ID NO: 4780 - RNA, 20 nt, Artificial sequence
  specific aptamers
gggugagguguggugcggcg

SEQ ID NO: 4781 - RNA, 20 nt, Artificial sequence
  specific aptamers
gggugagguguggugcggug

SEQ ID NO: 4782 - RNA, 20 nt, Artificial sequence
  specific aptamers
gggugaggugugguguggag

SEQ ID NO: 4783 - RNA, 20 nt, Artificial sequence
  specific aptamers
gggugaggugugguguggcg

SEQ ID NO: 4784 - RNA, 20 nt, Artificial sequence
  specific aptamers
gggugaggugugguguggug

SEQ ID NO: 4785 - RNA, 21 nt, Artificial sequence
  specific aptamers
ggguguggagaggaagaggag

SEQ ID NO: 4786 - RNA, 21 nt, Artificial sequence
  specific aptamers
ggguguggagaggaagaggcg

SEQ ID NO: 4787 - RNA, 21 nt, Artificial sequence
  specific aptamers
ggguguggagaggaagaggug

SEQ ID NO: 4788 - RNA, 21 nt, Artificial sequence
  specific aptamers
ggguguggagaggaagcggag

SEQ ID NO: 4789 - RNA, 21 nt, Artificial sequence
  specific aptamers
ggguguggagaggaagcggcg

SEQ ID NO: 4790 - RNA, 21 nt, Artificial sequence
  specific aptamers
ggguguggagaggaagcggug

SEQ ID NO: 4791 - RNA, 21 nt, Artificial sequence
  specific aptamers
ggguguggagaggaaguggag

SEQ ID NO: 4792 - RNA, 21 nt, Artificial sequence
  specific aptamers
ggguguggagaggaaguggcg

SEQ ID NO: 4793 - RNA, 21 nt, Artificial sequence
  specific aptamers
ggguguggagaggaaguggug

SEQ ID NO: 4794 - RNA, 21 nt, Artificial sequence
  specific aptamers
ggguguggagaggaugaggag

SEQ ID NO: 4795 - RNA, 21 nt, Artificial sequence
  specific aptamers
ggguguggagaggaugaggcg

SEQ ID NO: 4796 - RNA, 21 nt, Artificial sequence
  specific aptamers
ggguguggagaggaugaggug

SEQ ID NO: 4797 - RNA, 21 nt, Artificial sequence
  specific aptamers
ggguguggagaggaugcggag

SEQ ID NO: 4798 - RNA, 21 nt, Artificial sequence
  specific aptamers
ggguguggagaggaugcggcg

SEQ ID NO: 4799 - RNA, 21 nt, Artificial sequence
  specific aptamers
ggguguggagaggaugcggug

SEQ ID NO: 4800 - RNA, 21 nt, Artificial sequence
  specific aptamers
ggguguggagaggauguggag

SEQ ID NO: 4801 - RNA, 21 nt, Artificial sequence
  specific aptamers
ggguguggagaggauguggcg

SEQ ID NO: 4802 - RNA, 21 nt, Artificial sequence
  specific aptamers
ggguguggagaggauguggug

SEQ ID NO: 4803 - RNA, 20 nt, Artificial sequence
  specific aptamers
ggguguggagaggagaggag

SEQ ID NO: 4804 - RNA, 20 nt, Artificial sequence
  specific aptamers
ggguguggagaggagaggcg

SEQ ID NO: 4805 - RNA, 20 nt, Artificial sequence
  specific aptamers
ggguguggagaggagaggug

SEQ ID NO: 4806 - RNA, 20 nt, Artificial sequence
  specific aptamers
ggguguggagaggagcggag

SEQ ID NO: 4807 - RNA, 20 nt, Artificial sequence
  specific aptamers
ggguguggagaggagcggcg

SEQ ID NO: 4808 - RNA, 20 nt, Artificial sequence
  specific aptamers
ggguguggagaggagcggug

SEQ ID NO: 4809 - RNA, 20 nt, Artificial sequence
  specific aptamers
ggguguggagaggaguggag

SEQ ID NO: 4810 - RNA, 20 nt, Artificial sequence
  specific aptamers
ggguguggagaggaguggcg

SEQ ID NO: 4811 - RNA, 20 nt, Artificial sequence
  specific aptamers
ggguguggagaggaguggug

SEQ ID NO: 4812 - RNA, 21 nt, Artificial sequence
  specific aptamers
ggguguggagagguagaggag

SEQ ID NO: 4813 - RNA, 21 nt, Artificial sequence
  specific aptamers
ggguguggagagguagaggcg

SEQ ID NO: 4814 - RNA, 21 nt, Artificial sequence
  specific aptamers
ggguguggagagguagaggug

SEQ ID NO: 4815 - RNA, 21 nt, Artificial sequence
  specific aptamers
ggguguggagagguagcggag

SEQ ID NO: 4816 - RNA, 21 nt, Artificial sequence
  specific aptamers
ggguguggagagguagcggcg

SEQ ID NO: 4817 - RNA, 21 nt, Artificial sequence
  specific aptamers
ggguguggagagguagcggug

SEQ ID NO: 4818 - RNA, 21 nt, Artificial sequence
  specific aptamers
ggguguggagagguaguggag

SEQ ID NO: 4819 - RNA, 21 nt, Artificial sequence
  specific aptamers
ggguguggagagguaguggcg

SEQ ID NO: 4820 - RNA, 21 nt, Artificial sequence
  specific aptamers
ggguguggagagguaguggug

SEQ ID NO: 4821 - RNA, 21 nt, Artificial sequence
  specific aptamers
ggguguggagagguugaggag

SEQ ID NO: 4822 - RNA, 21 nt, Artificial sequence
  specific aptamers
ggguguggagagguugaggcg

SEQ ID NO: 4823 - RNA, 21 nt, Artificial sequence
  specific aptamers
ggguguggagagguugaggug

SEQ ID NO: 4824 - RNA, 21 nt, Artificial sequence
  specific aptamers
ggguguggagagguugcggag

SEQ ID NO: 4825 - RNA, 21 nt, Artificial sequence
  specific aptamers
ggguguggagagguugcggcg

SEQ ID NO: 4826 - RNA, 21 nt, Artificial sequence
  specific aptamers
ggguguggagagguugcggug

SEQ ID NO: 4827 - RNA, 21 nt, Artificial sequence
  specific aptamers
ggguguggagagguuguggag

SEQ ID NO: 4828 - RNA, 21 nt, Artificial sequence
  specific aptamers
ggguguggagagguuguggcg

SEQ ID NO: 4829 - RNA, 21 nt, Artificial sequence
  specific aptamers
ggguguggagagguuguggug

SEQ ID NO: 4830 - RNA, 20 nt, Artificial sequence
  specific aptamers
ggguguggagaggugaggag

SEQ ID NO: 4831 - RNA, 20 nt, Artificial sequence
  specific aptamers
ggguguggagaggugaggcg

SEQ ID NO: 4832 - RNA, 20 nt, Artificial sequence
  specific aptamers
ggguguggagaggugaggug

SEQ ID NO: 4833 - RNA, 20 nt, Artificial sequence
  specific aptamers
ggguguggagaggugcggag

SEQ ID NO: 4834 - RNA, 20 nt, Artificial sequence
  specific aptamers
ggguguggagaggugcggcg

SEQ ID NO: 4835 - RNA, 20 nt, Artificial sequence
  specific aptamers
ggguguggagaggugcggug

SEQ ID NO: 4836 - RNA, 20 nt, Artificial sequence
  specific aptamers
ggguguggagagguguggag

SEQ ID NO: 4837 - RNA, 20 nt, Artificial sequence
  specific aptamers
ggguguggagagguguggcg

SEQ ID NO: 4838 - RNA, 20 nt, Artificial sequence
  specific aptamers
ggguguggagagguguggug

SEQ ID NO: 4839 - RNA, 21 nt, Artificial sequence
  specific aptamers
ggguguggaguggaagaggag

SEQ ID NO: 4840 - RNA, 21 nt, Artificial sequence
  specific aptamers
ggguguggaguggaagaggcg

SEQ ID NO: 4841 - RNA, 21 nt, Artificial sequence
  specific aptamers
ggguguggaguggaagaggug

SEQ ID NO: 4842 - RNA, 21 nt, Artificial sequence
  specific aptamers
ggguguggaguggaagcggag

SEQ ID NO: 4843 - RNA, 21 nt, Artificial sequence
  specific aptamers
ggguguggaguggaagcggcg

SEQ ID NO: 4844 - RNA, 21 nt, Artificial sequence
  specific aptamers
ggguguggaguggaagcggug

SEQ ID NO: 4845 - RNA, 21 nt, Artificial sequence
  specific aptamers
ggguguggaguggaaguggag

SEQ ID NO: 4846 - RNA, 21 nt, Artificial sequence
  specific aptamers
ggguguggaguggaaguggcg

SEQ ID NO: 4847 - RNA, 21 nt, Artificial sequence
  specific aptamers
ggguguggaguggaaguggug

SEQ ID NO: 4848 - RNA, 21 nt, Artificial sequence
  specific aptamers
ggguguggaguggaugaggag

SEQ ID NO: 4849 - RNA, 21 nt, Artificial sequence
  specific aptamers
ggguguggaguggaugaggcg

SEQ ID NO: 4850 - RNA, 21 nt, Artificial sequence
  specific aptamers
ggguguggaguggaugaggug

SEQ ID NO: 4851 - RNA, 21 nt, Artificial sequence
  specific aptamers
ggguguggaguggaugcggag

SEQ ID NO: 4852 - RNA, 21 nt, Artificial sequence
  specific aptamers
ggguguggaguggaugcggcg

SEQ ID NO: 4853 - RNA, 21 nt, Artificial sequence
  specific aptamers
ggguguggaguggaugcggug

SEQ ID NO: 4854 - RNA, 21 nt, Artificial sequence
  specific aptamers
ggguguggaguggauguggag

SEQ ID NO: 4855 - RNA, 21 nt, Artificial sequence
  specific aptamers
ggguguggaguggauguggcg

SEQ ID NO: 4856 - RNA, 21 nt, Artificial sequence
  specific aptamers
ggguguggaguggauguggug

SEQ ID NO: 4857 - RNA, 20 nt, Artificial sequence
  specific aptamers
ggguguggaguggagaggag

SEQ ID NO: 4858 - RNA, 20 nt, Artificial sequence
  specific aptamers
ggguguggaguggagaggcg

SEQ ID NO: 4859 - RNA, 20 nt, Artificial sequence
  specific aptamers
ggguguggaguggagaggug

SEQ ID NO: 4860 - RNA, 20 nt, Artificial sequence
  specific aptamers
ggguguggaguggagcggag

SEQ ID NO: 4861 - RNA, 20 nt, Artificial sequence
  specific aptamers
ggguguggaguggagcggcg

SEQ ID NO: 4862 - RNA, 20 nt, Artificial sequence
  specific aptamers
ggguguggaguggagcggug

SEQ ID NO: 4863 - RNA, 20 nt, Artificial sequence
  specific aptamers
ggguguggaguggaguggag

SEQ ID NO: 4864 - RNA, 20 nt, Artificial sequence
  specific aptamers
ggguguggaguggaguggcg

SEQ ID NO: 4865 - RNA, 20 nt, Artificial sequence
  specific aptamers
ggguguggaguggaguggug

SEQ ID NO: 4866 - RNA, 21 nt, Artificial sequence
  specific aptamers
ggguguggagugguagaggag

SEQ ID NO: 4867 - RNA, 21 nt, Artificial sequence
  specific aptamers
ggguguggagugguagaggcg

SEQ ID NO: 4868 - RNA, 21 nt, Artificial sequence
  specific aptamers
ggguguggagugguagaggug

SEQ ID NO: 4869 - RNA, 21 nt, Artificial sequence
  specific aptamers
ggguguggagugguagcggag

SEQ ID NO: 4870 - RNA, 21 nt, Artificial sequence
  specific aptamers
ggguguggagugguagcggcg

SEQ ID NO: 4871 - RNA, 21 nt, Artificial sequence
  specific aptamers
ggguguggagugguagcggug

SEQ ID NO: 4872 - RNA, 21 nt, Artificial sequence
  specific aptamers
ggguguggagugguaguggag

SEQ ID NO: 4873 - RNA, 21 nt, Artificial sequence
  specific aptamers
ggguguggagugguaguggcg

SEQ ID NO: 4874 - RNA, 21 nt, Artificial sequence
  specific aptamers
ggguguggagugguaguggug

SEQ ID NO: 4875 - RNA, 21 nt, Artificial sequence
  specific aptamers
ggguguggagugguugaggag

SEQ ID NO: 4876 - RNA, 21 nt, Artificial sequence
  specific aptamers
ggguguggagugguugaggcg

SEQ ID NO: 4877 - RNA, 21 nt, Artificial sequence
  specific aptamers
ggguguggagugguugaggug

SEQ ID NO: 4878 - RNA, 21 nt, Artificial sequence
  specific aptamers
ggguguggagugguugcggag

SEQ ID NO: 4879 - RNA, 21 nt, Artificial sequence
  specific aptamers
ggguguggagugguugcggcg

SEQ ID NO: 4880 - RNA, 21 nt, Artificial sequence
  specific aptamers
ggguguggagugguugcggug

SEQ ID NO: 4881 - RNA, 21 nt, Artificial sequence
  specific aptamers
ggguguggagugguuguggag

SEQ ID NO: 4882 - RNA, 21 nt, Artificial sequence
  specific aptamers
ggguguggagugguuguggcg

SEQ ID NO: 4883 - RNA, 21 nt, Artificial sequence
  specific aptamers
ggguguggagugguuguggug

SEQ ID NO: 4884 - RNA, 20 nt, Artificial sequence
  specific aptamers
ggguguggaguggugaggag

SEQ ID NO: 4885 - RNA, 20 nt, Artificial sequence
  specific aptamers
ggguguggaguggugaggcg

SEQ ID NO: 4886 - RNA, 20 nt, Artificial sequence
  specific aptamers
ggguguggaguggugaggug

SEQ ID NO: 4887 - RNA, 20 nt, Artificial sequence
  specific aptamers
ggguguggaguggugcggag

SEQ ID NO: 4888 - RNA, 20 nt, Artificial sequence
  specific aptamers
ggguguggaguggugcggcg

SEQ ID NO: 4889 - RNA, 20 nt, Artificial sequence
  specific aptamers
ggguguggaguggugcggug

SEQ ID NO: 4890 - RNA, 20 nt, Artificial sequence
  specific aptamers
ggguguggagugguguggag

SEQ ID NO: 4891 - RNA, 20 nt, Artificial sequence
  specific aptamers
ggguguggagugguguggcg

SEQ ID NO: 4892 - RNA, 20 nt, Artificial sequence
  specific aptamers
ggguguggagugguguggug

SEQ ID NO: 4893 - RNA, 21 nt, Artificial sequence
  specific aptamers
ggguguggugaggaagaggag

SEQ ID NO: 4894 - RNA, 21 nt, Artificial sequence
  specific aptamers
ggguguggugaggaagaggcg

SEQ ID NO: 4895 - RNA, 21 nt, Artificial sequence
  specific aptamers
ggguguggugaggaagaggug

SEQ ID NO: 4896 - RNA, 21 nt, Artificial sequence
  specific aptamers
ggguguggugaggaagcggag

SEQ ID NO: 4897 - RNA, 21 nt, Artificial sequence
  specific aptamers
ggguguggugaggaagcggcg

SEQ ID NO: 4898 - RNA, 21 nt, Artificial sequence
  specific aptamers
ggguguggugaggaagcggug

SEQ ID NO: 4899 - RNA, 21 nt, Artificial sequence
  specific aptamers
ggguguggugaggaaguggag

SEQ ID NO: 4900 - RNA, 21 nt, Artificial sequence
  specific aptamers
ggguguggugaggaaguggcg

SEQ ID NO: 4901 - RNA, 21 nt, Artificial sequence
  specific aptamers
ggguguggugaggaaguggug

SEQ ID NO: 4902 - RNA, 21 nt, Artificial sequence
  specific aptamers
ggguguggugaggaugaggag

SEQ ID NO: 4903 - RNA, 21 nt, Artificial sequence
  specific aptamers
ggguguggugaggaugaggcg

SEQ ID NO: 4904 - RNA, 21 nt, Artificial sequence
  specific aptamers
ggguguggugaggaugaggug

SEQ ID NO: 4905 - RNA, 21 nt, Artificial sequence
  specific aptamers
ggguguggugaggaugcggag

SEQ ID NO: 4906 - RNA, 21 nt, Artificial sequence
  specific aptamers
ggguguggugaggaugcggcg

SEQ ID NO: 4907 - RNA, 21 nt, Artificial sequence
  specific aptamers
ggguguggugaggaugcggug

SEQ ID NO: 4908 - RNA, 21 nt, Artificial sequence
  specific aptamers
ggguguggugaggauguggag

SEQ ID NO: 4909 - RNA, 21 nt, Artificial sequence
  specific aptamers
ggguguggugaggauguggcg

SEQ ID NO: 4910 - RNA, 21 nt, Artificial sequence
  specific aptamers
ggguguggugaggauguggug

SEQ ID NO: 4911 - RNA, 20 nt, Artificial sequence
  specific aptamers
ggguguggugaggagaggag

SEQ ID NO: 4912 - RNA, 20 nt, Artificial sequence
  specific aptamers
ggguguggugaggagaggcg

SEQ ID NO: 4913 - RNA, 20 nt, Artificial sequence
  specific aptamers
ggguguggugaggagaggug

SEQ ID NO: 4914 - RNA, 20 nt, Artificial sequence
  specific aptamers
ggguguggugaggagcggag

SEQ ID NO: 4915 - RNA, 20 nt, Artificial sequence
  specific aptamers
ggguguggugaggagcggcg

SEQ ID NO: 4916 - RNA, 20 nt, Artificial sequence
  specific aptamers
ggguguggugaggagcggug

SEQ ID NO: 4917 - RNA, 20 nt, Artificial sequence
  specific aptamers
ggguguggugaggaguggag

SEQ ID NO: 4918 - RNA, 20 nt, Artificial sequence
  specific aptamers
ggguguggugaggaguggcg

SEQ ID NO: 4919 - RNA, 20 nt, Artificial sequence
  specific aptamers
ggguguggugaggaguggug

SEQ ID NO: 4920 - RNA, 21 nt, Artificial sequence
  specific aptamers
ggguguggugagguagaggag

SEQ ID NO: 4921 - RNA, 21 nt, Artificial sequence
  specific aptamers
ggguguggugagguagaggcg

SEQ ID NO: 4922 - RNA, 21 nt, Artificial sequence
  specific aptamers
ggguguggugagguagaggug

SEQ ID NO: 4923 - RNA, 21 nt, Artificial sequence
  specific aptamers
ggguguggugagguagcggag

SEQ ID NO: 4924 - RNA, 21 nt, Artificial sequence
  specific aptamers
ggguguggugagguagcggcg

SEQ ID NO: 4925 - RNA, 21 nt, Artificial sequence
  specific aptamers
ggguguggugagguagcggug

SEQ ID NO: 4926 - RNA, 21 nt, Artificial sequence
  specific aptamers
ggguguggugagguaguggag

SEQ ID NO: 4927 - RNA, 21 nt, Artificial sequence
  specific aptamers
ggguguggugagguaguggcg

SEQ ID NO: 4928 - RNA, 21 nt, Artificial sequence
  specific aptamers
ggguguggugagguaguggug

SEQ ID NO: 4929 - RNA, 21 nt, Artificial sequence
  specific aptamers
ggguguggugagguugaggag

SEQ ID NO: 4930 - RNA, 21 nt, Artificial sequence
  specific aptamers
ggguguggugagguugaggcg

SEQ ID NO: 4931 - RNA, 21 nt, Artificial sequence
  specific aptamers
ggguguggugagguugaggug

SEQ ID NO: 4932 - RNA, 21 nt, Artificial sequence
  specific aptamers
ggguguggugagguugcggag

SEQ ID NO: 4933 - RNA, 21 nt, Artificial sequence
  specific aptamers
ggguguggugagguugcggcg

SEQ ID NO: 4934 - RNA, 21 nt, Artificial sequence
  specific aptamers
ggguguggugagguugcggug

SEQ ID NO: 4935 - RNA, 21 nt, Artificial sequence
  specific aptamers
ggguguggugagguuguggag

SEQ ID NO: 4936 - RNA, 21 nt, Artificial sequence
  specific aptamers
ggguguggugagguuguggcg

SEQ ID NO: 4937 - RNA, 21 nt, Artificial sequence
  specific aptamers
ggguguggugagguuguggug

SEQ ID NO: 4938 - RNA, 20 nt, Artificial sequence
  specific aptamers
ggguguggugaggugaggag

SEQ ID NO: 4939 - RNA, 20 nt, Artificial sequence
  specific aptamers
ggguguggugaggugaggcg

SEQ ID NO: 4940 - RNA, 20 nt, Artificial sequence
  specific aptamers
ggguguggugaggugaggug

SEQ ID NO: 4941 - RNA, 20 nt, Artificial sequence
  specific aptamers
ggguguggugaggugcggag

SEQ ID NO: 4942 - RNA, 20 nt, Artificial sequence
  specific aptamers
ggguguggugaggugcggcg

SEQ ID NO: 4943 - RNA, 20 nt, Artificial sequence
  specific aptamers
ggguguggugaggugcggug

SEQ ID NO: 4944 - RNA, 20 nt, Artificial sequence
  specific aptamers
ggguguggugagguguggag

SEQ ID NO: 4945 - RNA, 20 nt, Artificial sequence
  specific aptamers
ggguguggugagguguggcg

SEQ ID NO: 4946 - RNA, 20 nt, Artificial sequence
  specific aptamers
ggguguggugagguguggug

SEQ ID NO: 4947 - RNA, 21 nt, Artificial sequence
  specific aptamers
gggugugguguggaagaggag

SEQ ID NO: 4948 - RNA, 21 nt, Artificial sequence
  specific aptamers
gggugugguguggaagaggcg

SEQ ID NO: 4949 - RNA, 21 nt, Artificial sequence
  specific aptamers
gggugugguguggaagaggug

SEQ ID NO: 4950 - RNA, 21 nt, Artificial sequence
  specific aptamers
gggugugguguggaagcggag

SEQ ID NO: 4951 - RNA, 21 nt, Artificial sequence
  specific aptamers
gggugugguguggaagcggcg

SEQ ID NO: 4952 - RNA, 21 nt, Artificial sequence
  specific aptamers
gggugugguguggaagcggug

SEQ ID NO: 4953 - RNA, 21 nt, Artificial sequence
  specific aptamers
gggugugguguggaaguggag

SEQ ID NO: 4954 - RNA, 21 nt, Artificial sequence
  specific aptamers
gggugugguguggaaguggcg

SEQ ID NO: 4955 - RNA, 21 nt, Artificial sequence
  specific aptamers
gggugugguguggaaguggug

SEQ ID NO: 4956 - RNA, 21 nt, Artificial sequence
  specific aptamers
gggugugguguggaugaggag

SEQ ID NO: 4957 - RNA, 21 nt, Artificial sequence
  specific aptamers
gggugugguguggaugaggcg

SEQ ID NO: 4958 - RNA, 21 nt, Artificial sequence
  specific aptamers
gggugugguguggaugaggug

SEQ ID NO: 4959 - RNA, 21 nt, Artificial sequence
  specific aptamers
gggugugguguggaugcggag

SEQ ID NO: 4960 - RNA, 21 nt, Artificial sequence
  specific aptamers
gggugugguguggaugcggcg

SEQ ID NO: 4961 - RNA, 21 nt, Artificial sequence
  specific aptamers
gggugugguguggaugcggug

SEQ ID NO: 4962 - RNA, 21 nt, Artificial sequence
  specific aptamers
gggugugguguggauguggag

SEQ ID NO: 4963 - RNA, 21 nt, Artificial sequence
  specific aptamers
gggugugguguggauguggcg

SEQ ID NO: 4964 - RNA, 21 nt, Artificial sequence
  specific aptamers
gggugugguguggauguggug

SEQ ID NO: 4965 - RNA, 20 nt, Artificial sequence
  specific aptamers
gggugugguguggagaggag

SEQ ID NO: 4966 - RNA, 20 nt, Artificial sequence
  specific aptamers
gggugugguguggagaggcg

SEQ ID NO: 4967 - RNA, 20 nt, Artificial sequence
  specific aptamers
gggugugguguggagaggug

SEQ ID NO: 4968 - RNA, 20 nt, Artificial sequence
  specific aptamers
gggugugguguggagcggag

SEQ ID NO: 4969 - RNA, 20 nt, Artificial sequence
  specific aptamers
gggugugguguggagcggcg

SEQ ID NO: 4970 - RNA, 20 nt, Artificial sequence
  specific aptamers
gggugugguguggagcggug

SEQ ID NO: 4971 - RNA, 20 nt, Artificial sequence
  specific aptamers
gggugugguguggaguggag

SEQ ID NO: 4972 - RNA, 20 nt, Artificial sequence
  specific aptamers
gggugugguguggaguggcg

SEQ ID NO: 4973 - RNA, 20 nt, Artificial sequence
  specific aptamers
gggugugguguggaguggug

SEQ ID NO: 4974 - RNA, 21 nt, Artificial sequence
  specific aptamers
ggguguggugugguagaggag

SEQ ID NO: 4975 - RNA, 21 nt, Artificial sequence
  specific aptamers
ggguguggugugguagaggcg

SEQ ID NO: 4976 - RNA, 21 nt, Artificial sequence
  specific aptamers
ggguguggugugguagaggug

SEQ ID NO: 4977 - RNA, 21 nt, Artificial sequence
  specific aptamers
ggguguggugugguagcggag

SEQ ID NO: 4978 - RNA, 21 nt, Artificial sequence
  specific aptamers
ggguguggugugguagcggcg

SEQ ID NO: 4979 - RNA, 21 nt, Artificial sequence
  specific aptamers
ggguguggugugguagcggug

SEQ ID NO: 4980 - RNA, 21 nt, Artificial sequence
  specific aptamers
ggguguggugugguaguggag

SEQ ID NO: 4981 - RNA, 21 nt, Artificial sequence
  specific aptamers
ggguguggugugguaguggcg

SEQ ID NO: 4982 - RNA, 21 nt, Artificial sequence
  specific aptamers
ggguguggugugguaguggug

SEQ ID NO: 4983 - RNA, 21 nt, Artificial sequence
  specific aptamers
ggguguggugugguugaggag

SEQ ID NO: 4984 - RNA, 21 nt, Artificial sequence
  specific aptamers
ggguguggugugguugaggcg

SEQ ID NO: 4985 - RNA, 21 nt, Artificial sequence
  specific aptamers
ggguguggugugguugaggug

SEQ ID NO: 4986 - RNA, 21 nt, Artificial sequence
  specific aptamers
ggguguggugugguugcggag

SEQ ID NO: 4987 - RNA, 21 nt, Artificial sequence
  specific aptamers
ggguguggugugguugcggcg

SEQ ID NO: 4988 - RNA, 21 nt, Artificial sequence
  specific aptamers
ggguguggugugguugcggug

SEQ ID NO: 4989 - RNA, 21 nt, Artificial sequence
  specific aptamers
ggguguggugugguuguggag

SEQ ID NO: 4990 - RNA, 21 nt, Artificial sequence
  specific aptamers
ggguguggugugguuguggcg

SEQ ID NO: 4991 - RNA, 21 nt, Artificial sequence
  specific aptamers
ggguguggugugguuguggug

SEQ ID NO: 4992 - RNA, 20 nt, Artificial sequence
  specific aptamers
gggugugguguggugaggag

SEQ ID NO: 4993 - RNA, 20 nt, Artificial sequence
  specific aptamers
gggugugguguggugaggcg

SEQ ID NO: 4994 - RNA, 20 nt, Artificial sequence
  specific aptamers
gggugugguguggugaggug

SEQ ID NO: 4995 - RNA, 20 nt, Artificial sequence
  specific aptamers
gggugugguguggugcggag

SEQ ID NO: 4996 - RNA, 20 nt, Artificial sequence
  specific aptamers
gggugugguguggugcggcg

SEQ ID NO: 4997 - RNA, 20 nt, Artificial sequence
  specific aptamers
gggugugguguggugcggug

SEQ ID NO: 4998 - RNA, 20 nt, Artificial sequence
  specific aptamers
ggguguggugugguguggag

SEQ ID NO: 4999 - RNA, 20 nt, Artificial sequence
  specific aptamers
ggguguggugugguguggcg

SEQ ID NO: 5000 - RNA, 20 nt, Artificial sequence
  specific aptamers
ggguguggugugguguggug

SEQ ID NO: 5001 - RNA, 21 nt, Artificial sequence
  specific aptamers
gguagaggagaggaagaggag

SEQ ID NO: 5002 - RNA, 21 nt, Artificial sequence
  specific aptamers
gguagaggagaggaagaggcg

SEQ ID NO: 5003 - RNA, 21 nt, Artificial sequence
  specific aptamers
gguagaggagaggaagaggug

SEQ ID NO: 5004 - RNA, 21 nt, Artificial sequence
  specific aptamers
gguagaggagaggaagcggag

SEQ ID NO: 5005 - RNA, 21 nt, Artificial sequence
  specific aptamers
gguagaggagaggaagcggcg

SEQ ID NO: 5006 - RNA, 21 nt, Artificial sequence
  specific aptamers
gguagaggagaggaagcggug

SEQ ID NO: 5007 - RNA, 21 nt, Artificial sequence
  specific aptamers
gguagaggagaggaaguggag

SEQ ID NO: 5008 - RNA, 21 nt, Artificial sequence
  specific aptamers
gguagaggagaggaaguggcg

SEQ ID NO: 5009 - RNA, 21 nt, Artificial sequence
  specific aptamers
gguagaggagaggaaguggug

SEQ ID NO: 5010 - RNA, 21 nt, Artificial sequence
  specific aptamers
gguagaggagaggaugaggag

SEQ ID NO: 5011 - RNA, 21 nt, Artificial sequence
  specific aptamers
gguagaggagaggaugaggcg

SEQ ID NO: 5012 - RNA, 21 nt, Artificial sequence
  specific aptamers
gguagaggagaggaugaggug

SEQ ID NO: 5013 - RNA, 21 nt, Artificial sequence
  specific aptamers
gguagaggagaggaugcggag

SEQ ID NO: 5014 - RNA, 21 nt, Artificial sequence
  specific aptamers
gguagaggagaggaugcggcg

SEQ ID NO: 5015 - RNA, 21 nt, Artificial sequence
  specific aptamers
gguagaggagaggaugcggug

SEQ ID NO: 5016 - RNA, 21 nt, Artificial sequence
  specific aptamers
gguagaggagaggauguggag

SEQ ID NO: 5017 - RNA, 21 nt, Artificial sequence
  specific aptamers
gguagaggagaggauguggcg

SEQ ID NO: 5018 - RNA, 21 nt, Artificial sequence
  specific aptamers
gguagaggagaggauguggug

SEQ ID NO: 5019 - RNA, 20 nt, Artificial sequence
  specific aptamers
gguagaggagaggagaggag

SEQ ID NO: 5020 - RNA, 20 nt, Artificial sequence
  specific aptamers
gguagaggagaggagaggcg

SEQ ID NO: 5021 - RNA, 20 nt, Artificial sequence
  specific aptamers
gguagaggagaggagaggug

SEQ ID NO: 5022 - RNA, 20 nt, Artificial sequence
  specific aptamers
gguagaggagaggagcggag

SEQ ID NO: 5023 - RNA, 20 nt, Artificial sequence
  specific aptamers
gguagaggagaggagcggcg

SEQ ID NO: 5024 - RNA, 20 nt, Artificial sequence
  specific aptamers
gguagaggagaggagcggug

SEQ ID NO: 5025 - RNA, 20 nt, Artificial sequence
  specific aptamers
gguagaggagaggaguggag

SEQ ID NO: 5026 - RNA, 20 nt, Artificial sequence
  specific aptamers
gguagaggagaggaguggcg

SEQ ID NO: 5027 - RNA, 20 nt, Artificial sequence
  specific aptamers
gguagaggagaggaguggug

SEQ ID NO: 5028 - RNA, 21 nt, Artificial sequence
  specific aptamers
gguagaggagagguagaggag

SEQ ID NO: 5029 - RNA, 21 nt, Artificial sequence
  specific aptamers
gguagaggagagguagaggcg

SEQ ID NO: 5030 - RNA, 21 nt, Artificial sequence
  specific aptamers
gguagaggagagguagaggug

SEQ ID NO: 5031 - RNA, 21 nt, Artificial sequence
  specific aptamers
gguagaggagagguagcggag

SEQ ID NO: 5032 - RNA, 21 nt, Artificial sequence
  specific aptamers
gguagaggagagguagcggcg

SEQ ID NO: 5033 - RNA, 21 nt, Artificial sequence
  specific aptamers
gguagaggagagguagcggug

SEQ ID NO: 5034 - RNA, 21 nt, Artificial sequence
  specific aptamers
gguagaggagagguaguggag

SEQ ID NO: 5035 - RNA, 21 nt, Artificial sequence
  specific aptamers
gguagaggagagguaguggcg

SEQ ID NO: 5036 - RNA, 21 nt, Artificial sequence
  specific aptamers
gguagaggagagguaguggug

SEQ ID NO: 5037 - RNA, 21 nt, Artificial sequence
  specific aptamers
gguagaggagagguugaggag

SEQ ID NO: 5038 - RNA, 21 nt, Artificial sequence
  specific aptamers
gguagaggagagguugaggcg

SEQ ID NO: 5039 - RNA, 21 nt, Artificial sequence
  specific aptamers
gguagaggagagguugaggug

SEQ ID NO: 5040 - RNA, 21 nt, Artificial sequence
  specific aptamers
gguagaggagagguugcggag

SEQ ID NO: 5041 - RNA, 21 nt, Artificial sequence
  specific aptamers
gguagaggagagguugcggcg

SEQ ID NO: 5042 - RNA, 21 nt, Artificial sequence
  specific aptamers
gguagaggagagguugcggug

SEQ ID NO: 5043 - RNA, 21 nt, Artificial sequence
  specific aptamers
gguagaggagagguuguggag

SEQ ID NO: 5044 - RNA, 21 nt, Artificial sequence
  specific aptamers
gguagaggagagguuguggcg

SEQ ID NO: 5045 - RNA, 21 nt, Artificial sequence
  specific aptamers
gguagaggagagguuguggug

SEQ ID NO: 5046 - RNA, 20 nt, Artificial sequence
  specific aptamers
gguagaggagaggugaggag

SEQ ID NO: 5047 - RNA, 20 nt, Artificial sequence
  specific aptamers
gguagaggagaggugaggcg

SEQ ID NO: 5048 - RNA, 20 nt, Artificial sequence
  specific aptamers
gguagaggagaggugaggug

SEQ ID NO: 5049 - RNA, 20 nt, Artificial sequence
  specific aptamers
gguagaggagaggugcggag

SEQ ID NO: 5050 - RNA, 20 nt, Artificial sequence
  specific aptamers
gguagaggagaggugcggcg

SEQ ID NO: 5051 - RNA, 20 nt, Artificial sequence
  specific aptamers
gguagaggagaggugcggug

SEQ ID NO: 5052 - RNA, 20 nt, Artificial sequence
  specific aptamers
gguagaggagagguguggag

SEQ ID NO: 5053 - RNA, 20 nt, Artificial sequence
  specific aptamers
gguagaggagagguguggcg

SEQ ID NO: 5054 - RNA, 20 nt, Artificial sequence
  specific aptamers
gguagaggagagguguggug

SEQ ID NO: 5055 - RNA, 21 nt, Artificial sequence
  specific aptamers
gguagaggaguggaagaggag

SEQ ID NO: 5056 - RNA, 21 nt, Artificial sequence
  specific aptamers
gguagaggaguggaagaggcg

SEQ ID NO: 5057 - RNA, 21 nt, Artificial sequence
  specific aptamers
gguagaggaguggaagaggug

SEQ ID NO: 5058 - RNA, 21 nt, Artificial sequence
  specific aptamers
gguagaggaguggaagcggag

SEQ ID NO: 5059 - RNA, 21 nt, Artificial sequence
  specific aptamers
gguagaggaguggaagcggcg

SEQ ID NO: 5060 - RNA, 21 nt, Artificial sequence
  specific aptamers
gguagaggaguggaagcggug

SEQ ID NO: 5061 - RNA, 21 nt, Artificial sequence
  specific aptamers
gguagaggaguggaaguggag

SEQ ID NO: 5062 - RNA, 21 nt, Artificial sequence
  specific aptamers
gguagaggaguggaaguggcg

SEQ ID NO: 5063 - RNA, 21 nt, Artificial sequence
  specific aptamers
gguagaggaguggaaguggug

SEQ ID NO: 5064 - RNA, 21 nt, Artificial sequence
  specific aptamers
gguagaggaguggaugaggag

SEQ ID NO: 5065 - RNA, 21 nt, Artificial sequence
  specific aptamers
gguagaggaguggaugaggcg

SEQ ID NO: 5066 - RNA, 21 nt, Artificial sequence
  specific aptamers
gguagaggaguggaugaggug

SEQ ID NO: 5067 - RNA, 21 nt, Artificial sequence
  specific aptamers
gguagaggaguggaugcggag

SEQ ID NO: 5068 - RNA, 21 nt, Artificial sequence
  specific aptamers
gguagaggaguggaugcggcg

SEQ ID NO: 5069 - RNA, 21 nt, Artificial sequence
  specific aptamers
gguagaggaguggaugcggug

SEQ ID NO: 5070 - RNA, 21 nt, Artificial sequence
  specific aptamers
gguagaggaguggauguggag

SEQ ID NO: 5071 - RNA, 21 nt, Artificial sequence
  specific aptamers
gguagaggaguggauguggcg

SEQ ID NO: 5072 - RNA, 21 nt, Artificial sequence
  specific aptamers
gguagaggaguggauguggug

SEQ ID NO: 5073 - RNA, 20 nt, Artificial sequence
  specific aptamers
gguagaggaguggagaggag

SEQ ID NO: 5074 - RNA, 20 nt, Artificial sequence
  specific aptamers
gguagaggaguggagaggcg

SEQ ID NO: 5075 - RNA, 20 nt, Artificial sequence
  specific aptamers
gguagaggaguggagaggug

SEQ ID NO: 5076 - RNA, 20 nt, Artificial sequence
  specific aptamers
gguagaggaguggagcggag

SEQ ID NO: 5077 - RNA, 20 nt, Artificial sequence
  specific aptamers
gguagaggaguggagcggcg

SEQ ID NO: 5078 - RNA, 20 nt, Artificial sequence
  specific aptamers
gguagaggaguggagcggug

SEQ ID NO: 5079 - RNA, 20 nt, Artificial sequence
  specific aptamers
gguagaggaguggaguggag

SEQ ID NO: 5080 - RNA, 20 nt, Artificial sequence
  specific aptamers
gguagaggaguggaguggcg

SEQ ID NO: 5081 - RNA, 20 nt, Artificial sequence
  specific aptamers
gguagaggaguggaguggug

SEQ ID NO: 5082 - RNA, 21 nt, Artificial sequence
  specific aptamers
gguagaggagugguagaggag

SEQ ID NO: 5083 - RNA, 21 nt, Artificial sequence
  specific aptamers
gguagaggagugguagaggcg

SEQ ID NO: 5084 - RNA, 21 nt, Artificial sequence
  specific aptamers
gguagaggagugguagaggug

SEQ ID NO: 5085 - RNA, 21 nt, Artificial sequence
  specific aptamers
gguagaggagugguagcggag

SEQ ID NO: 5086 - RNA, 21 nt, Artificial sequence
  specific aptamers
gguagaggagugguagcggcg

SEQ ID NO: 5087 - RNA, 21 nt, Artificial sequence
  specific aptamers
gguagaggagugguagcggug

SEQ ID NO: 5088 - RNA, 21 nt, Artificial sequence
  specific aptamers
gguagaggagugguaguggag

SEQ ID NO: 5089 - RNA, 21 nt, Artificial sequence
  specific aptamers
gguagaggagugguaguggcg

SEQ ID NO: 5090 - RNA, 21 nt, Artificial sequence
  specific aptamers
gguagaggagugguaguggug

SEQ ID NO: 5091 - RNA, 21 nt, Artificial sequence
  specific aptamers
gguagaggagugguugaggag

SEQ ID NO: 5092 - RNA, 21 nt, Artificial sequence
  specific aptamers
gguagaggagugguugaggcg

SEQ ID NO: 5093 - RNA, 21 nt, Artificial sequence
  specific aptamers
gguagaggagugguugaggug

SEQ ID NO: 5094 - RNA, 21 nt, Artificial sequence
  specific aptamers
gguagaggagugguugcggag

SEQ ID NO: 5095 - RNA, 21 nt, Artificial sequence
  specific aptamers
gguagaggagugguugcggcg

SEQ ID NO: 5096 - RNA, 21 nt, Artificial sequence
  specific aptamers
gguagaggagugguugcggug

SEQ ID NO: 5097 - RNA, 21 nt, Artificial sequence
  specific aptamers
gguagaggagugguuguggag

SEQ ID NO: 5098 - RNA, 21 nt, Artificial sequence
  specific aptamers
gguagaggagugguuguggcg

SEQ ID NO: 5099 - RNA, 21 nt, Artificial sequence
  specific aptamers
gguagaggagugguuguggug

SEQ ID NO: 5100 - RNA, 20 nt, Artificial sequence
  specific aptamers
gguagaggaguggugaggag

SEQ ID NO: 5101 - RNA, 20 nt, Artificial sequence
  specific aptamers
gguagaggaguggugaggcg

SEQ ID NO: 5102 - RNA, 20 nt, Artificial sequence
  specific aptamers
gguagaggaguggugaggug

SEQ ID NO: 5103 - RNA, 20 nt, Artificial sequence
  specific aptamers
gguagaggaguggugcggag

SEQ ID NO: 5104 - RNA, 20 nt, Artificial sequence
  specific aptamers
gguagaggaguggugcggcg

SEQ ID NO: 5105 - RNA, 20 nt, Artificial sequence
  specific aptamers
gguagaggaguggugcggug

SEQ ID NO: 5106 - RNA, 20 nt, Artificial sequence
  specific aptamers
gguagaggagugguguggag

SEQ ID NO: 5107 - RNA, 20 nt, Artificial sequence
  specific aptamers
gguagaggagugguguggcg

SEQ ID NO: 5108 - RNA, 20 nt, Artificial sequence
  specific aptamers
gguagaggagugguguggug

SEQ ID NO: 5109 - RNA, 21 nt, Artificial sequence
  specific aptamers
gguagaggugaggaagaggag

SEQ ID NO: 5110 - RNA, 21 nt, Artificial sequence
  specific aptamers
gguagaggugaggaagaggcg

SEQ ID NO: 5111 - RNA, 21 nt, Artificial sequence
  specific aptamers
gguagaggugaggaagaggug

SEQ ID NO: 5112 - RNA, 21 nt, Artificial sequence
  specific aptamers
gguagaggugaggaagcggag

SEQ ID NO: 5113 - RNA, 21 nt, Artificial sequence
  specific aptamers
gguagaggugaggaagcggcg

SEQ ID NO: 5114 - RNA, 21 nt, Artificial sequence
  specific aptamers
gguagaggugaggaagcggug

SEQ ID NO: 5115 - RNA, 21 nt, Artificial sequence
  specific aptamers
gguagaggugaggaaguggag

SEQ ID NO: 5116 - RNA, 21 nt, Artificial sequence
  specific aptamers
gguagaggugaggaaguggcg

SEQ ID NO: 5117 - RNA, 21 nt, Artificial sequence
  specific aptamers
gguagaggugaggaaguggug

SEQ ID NO: 5118 - RNA, 21 nt, Artificial sequence
  specific aptamers
gguagaggugaggaugaggag

SEQ ID NO: 5119 - RNA, 21 nt, Artificial sequence
  specific aptamers
gguagaggugaggaugaggcg

SEQ ID NO: 5120 - RNA, 21 nt, Artificial sequence
  specific aptamers
gguagaggugaggaugaggug

SEQ ID NO: 5121 - RNA, 21 nt, Artificial sequence
  specific aptamers
gguagaggugaggaugcggag

SEQ ID NO: 5122 - RNA, 21 nt, Artificial sequence
  specific aptamers
gguagaggugaggaugcggcg

SEQ ID NO: 5123 - RNA, 21 nt, Artificial sequence
  specific aptamers
gguagaggugaggaugcggug

SEQ ID NO: 5124 - RNA, 21 nt, Artificial sequence
  specific aptamers
gguagaggugaggauguggag

SEQ ID NO: 5125 - RNA, 21 nt, Artificial sequence
  specific aptamers
gguagaggugaggauguggcg

SEQ ID NO: 5126 - RNA, 21 nt, Artificial sequence
  specific aptamers
gguagaggugaggauguggug

SEQ ID NO: 5127 - RNA, 20 nt, Artificial sequence
  specific aptamers
gguagaggugaggagaggag

SEQ ID NO: 5128 - RNA, 20 nt, Artificial sequence
  specific aptamers
gguagaggugaggagaggcg

SEQ ID NO: 5129 - RNA, 20 nt, Artificial sequence
  specific aptamers
gguagaggugaggagaggug

SEQ ID NO: 5130 - RNA, 20 nt, Artificial sequence
  specific aptamers
gguagaggugaggagcggag

SEQ ID NO: 5131 - RNA, 20 nt, Artificial sequence
  specific aptamers
gguagaggugaggagcggcg

SEQ ID NO: 5132 - RNA, 20 nt, Artificial sequence
  specific aptamers
gguagaggugaggagcggug

SEQ ID NO: 5133 - RNA, 20 nt, Artificial sequence
  specific aptamers
gguagaggugaggaguggag

SEQ ID NO: 5134 - RNA, 20 nt, Artificial sequence
  specific aptamers
gguagaggugaggaguggcg

SEQ ID NO: 5135 - RNA, 20 nt, Artificial sequence
  specific aptamers
gguagaggugaggaguggug

SEQ ID NO: 5136 - RNA, 21 nt, Artificial sequence
  specific aptamers
gguagaggugagguagaggag

SEQ ID NO: 5137 - RNA, 21 nt, Artificial sequence
  specific aptamers
gguagaggugagguagaggcg

SEQ ID NO: 5138 - RNA, 21 nt, Artificial sequence
  specific aptamers
gguagaggugagguagaggug

SEQ ID NO: 5139 - RNA, 21 nt, Artificial sequence
  specific aptamers
gguagaggugagguagcggag

SEQ ID NO: 5140 - RNA, 21 nt, Artificial sequence
  specific aptamers
gguagaggugagguagcggcg

SEQ ID NO: 5141 - RNA, 21 nt, Artificial sequence
  specific aptamers
gguagaggugagguagcggug

SEQ ID NO: 5142 - RNA, 21 nt, Artificial sequence
  specific aptamers
gguagaggugagguaguggag

SEQ ID NO: 5143 - RNA, 21 nt, Artificial sequence
  specific aptamers
gguagaggugagguaguggcg

SEQ ID NO: 5144 - RNA, 21 nt, Artificial sequence
  specific aptamers
gguagaggugagguaguggug

SEQ ID NO: 5145 - RNA, 21 nt, Artificial sequence
  specific aptamers
gguagaggugagguugaggag

SEQ ID NO: 5146 - RNA, 21 nt, Artificial sequence
  specific aptamers
gguagaggugagguugaggcg

SEQ ID NO: 5147 - RNA, 21 nt, Artificial sequence
  specific aptamers
gguagaggugagguugaggug

SEQ ID NO: 5148 - RNA, 21 nt, Artificial sequence
  specific aptamers
gguagaggugagguugcggag

SEQ ID NO: 5149 - RNA, 21 nt, Artificial sequence
  specific aptamers
gguagaggugagguugcggcg

SEQ ID NO: 5150 - RNA, 21 nt, Artificial sequence
  specific aptamers
gguagaggugagguugcggug

SEQ ID NO: 5151 - RNA, 21 nt, Artificial sequence
  specific aptamers
gguagaggugagguuguggag

SEQ ID NO: 5152 - RNA, 21 nt, Artificial sequence
  specific aptamers
gguagaggugagguuguggcg

SEQ ID NO: 5153 - RNA, 21 nt, Artificial sequence
  specific aptamers
gguagaggugagguuguggug

SEQ ID NO: 5154 - RNA, 20 nt, Artificial sequence
  specific aptamers
gguagaggugaggugaggag

SEQ ID NO: 5155 - RNA, 20 nt, Artificial sequence
  specific aptamers
gguagaggugaggugaggcg

SEQ ID NO: 5156 - RNA, 20 nt, Artificial sequence
  specific aptamers
gguagaggugaggugaggug

SEQ ID NO: 5157 - RNA, 20 nt, Artificial sequence
  specific aptamers
gguagaggugaggugcggag

SEQ ID NO: 5158 - RNA, 20 nt, Artificial sequence
  specific aptamers
gguagaggugaggugcggcg

SEQ ID NO: 5159 - RNA, 20 nt, Artificial sequence
  specific aptamers
gguagaggugaggugcggug

SEQ ID NO: 5160 - RNA, 20 nt, Artificial sequence
  specific aptamers
gguagaggugagguguggag

SEQ ID NO: 5161 - RNA, 20 nt, Artificial sequence
  specific aptamers
gguagaggugagguguggcg

SEQ ID NO: 5162 - RNA, 20 nt, Artificial sequence
  specific aptamers
gguagaggugagguguggug

SEQ ID NO: 5163 - RNA, 21 nt, Artificial sequence
  specific aptamers
gguagagguguggaagaggag

SEQ ID NO: 5164 - RNA, 21 nt, Artificial sequence
  specific aptamers
gguagagguguggaagaggcg

SEQ ID NO: 5165 - RNA, 21 nt, Artificial sequence
  specific aptamers
gguagagguguggaagaggug

SEQ ID NO: 5166 - RNA, 21 nt, Artificial sequence
  specific aptamers
gguagagguguggaagcggag

SEQ ID NO: 5167 - RNA, 21 nt, Artificial sequence
  specific aptamers
gguagagguguggaagcggcg

SEQ ID NO: 5168 - RNA, 21 nt, Artificial sequence
  specific aptamers
gguagagguguggaagcggug

SEQ ID NO: 5169 - RNA, 21 nt, Artificial sequence
  specific aptamers
gguagagguguggaaguggag

SEQ ID NO: 5170 - RNA, 21 nt, Artificial sequence
  specific aptamers
gguagagguguggaaguggcg

SEQ ID NO: 5171 - RNA, 21 nt, Artificial sequence
  specific aptamers
gguagagguguggaaguggug

SEQ ID NO: 5172 - RNA, 21 nt, Artificial sequence
  specific aptamers
gguagagguguggaugaggag

SEQ ID NO: 5173 - RNA, 21 nt, Artificial sequence
  specific aptamers
gguagagguguggaugaggcg

SEQ ID NO: 5174 - RNA, 21 nt, Artificial sequence
  specific aptamers
gguagagguguggaugaggug

SEQ ID NO: 5175 - RNA, 21 nt, Artificial sequence
  specific aptamers
gguagagguguggaugcggag

SEQ ID NO: 5176 - RNA, 21 nt, Artificial sequence
  specific aptamers
gguagagguguggaugcggcg

SEQ ID NO: 5177 - RNA, 21 nt, Artificial sequence
  specific aptamers
gguagagguguggaugcggug

SEQ ID NO: 5178 - RNA, 21 nt, Artificial sequence
  specific aptamers
gguagagguguggauguggag

SEQ ID NO: 5179 - RNA, 21 nt, Artificial sequence
  specific aptamers
gguagagguguggauguggcg

SEQ ID NO: 5180 - RNA, 21 nt, Artificial sequence
  specific aptamers
gguagagguguggauguggug

SEQ ID NO: 5181 - RNA, 20 nt, Artificial sequence
  specific aptamers
gguagagguguggagaggag

SEQ ID NO: 5182 - RNA, 20 nt, Artificial sequence
  specific aptamers
gguagagguguggagaggcg

SEQ ID NO: 5183 - RNA, 20 nt, Artificial sequence
  specific aptamers
gguagagguguggagaggug

SEQ ID NO: 5184 - RNA, 20 nt, Artificial sequence
  specific aptamers
gguagagguguggagcggag

SEQ ID NO: 5185 - RNA, 20 nt, Artificial sequence
  specific aptamers
gguagagguguggagcggcg

SEQ ID NO: 5186 - RNA, 20 nt, Artificial sequence
  specific aptamers
gguagagguguggagcggug

SEQ ID NO: 5187 - RNA, 20 nt, Artificial sequence
  specific aptamers
gguagagguguggaguggag

SEQ ID NO: 5188 - RNA, 20 nt, Artificial sequence
  specific aptamers
gguagagguguggaguggcg

SEQ ID NO: 5189 - RNA, 20 nt, Artificial sequence
  specific aptamers
gguagagguguggaguggug

SEQ ID NO: 5190 - RNA, 21 nt, Artificial sequence
  specific aptamers
gguagaggugugguagaggag

SEQ ID NO: 5191 - RNA, 21 nt, Artificial sequence
  specific aptamers
gguagaggugugguagaggcg

SEQ ID NO: 5192 - RNA, 21 nt, Artificial sequence
  specific aptamers
gguagaggugugguagaggug

SEQ ID NO: 5193 - RNA, 21 nt, Artificial sequence
  specific aptamers
gguagaggugugguagcggag

SEQ ID NO: 5194 - RNA, 21 nt, Artificial sequence
  specific aptamers
gguagaggugugguagcggcg

SEQ ID NO: 5195 - RNA, 21 nt, Artificial sequence
  specific aptamers
gguagaggugugguagcggug

SEQ ID NO: 5196 - RNA, 21 nt, Artificial sequence
  specific aptamers
gguagaggugugguaguggag

SEQ ID NO: 5197 - RNA, 21 nt, Artificial sequence
  specific aptamers
gguagaggugugguaguggcg

SEQ ID NO: 5198 - RNA, 21 nt, Artificial sequence
  specific aptamers
gguagaggugugguaguggug

SEQ ID NO: 5199 - RNA, 21 nt, Artificial sequence
  specific aptamers
gguagaggugugguugaggag

SEQ ID NO: 5200 - RNA, 21 nt, Artificial sequence
  specific aptamers
gguagaggugugguugaggcg

SEQ ID NO: 5201 - RNA, 21 nt, Artificial sequence
  specific aptamers
gguagaggugugguugaggug

SEQ ID NO: 5202 - RNA, 21 nt, Artificial sequence
  specific aptamers
gguagaggugugguugcggag

SEQ ID NO: 5203 - RNA, 21 nt, Artificial sequence
  specific aptamers
gguagaggugugguugcggcg

SEQ ID NO: 5204 - RNA, 21 nt, Artificial sequence
  specific aptamers
gguagaggugugguugcggug

SEQ ID NO: 5205 - RNA, 21 nt, Artificial sequence
  specific aptamers
gguagaggugugguuguggag

SEQ ID NO: 5206 - RNA, 21 nt, Artificial sequence
  specific aptamers
gguagaggugugguuguggcg

SEQ ID NO: 5207 - RNA, 21 nt, Artificial sequence
  specific aptamers
gguagaggugugguuguggug

SEQ ID NO: 5208 - RNA, 20 nt, Artificial sequence
  specific aptamers
gguagagguguggugaggag

SEQ ID NO: 5209 - RNA, 20 nt, Artificial sequence
  specific aptamers
gguagagguguggugaggcg

SEQ ID NO: 5210 - RNA, 20 nt, Artificial sequence
  specific aptamers
gguagagguguggugaggug

SEQ ID NO: 5211 - RNA, 20 nt, Artificial sequence
  specific aptamers
gguagagguguggugcggag

SEQ ID NO: 5212 - RNA, 20 nt, Artificial sequence
  specific aptamers
gguagagguguggugcggcg

SEQ ID NO: 5213 - RNA, 20 nt, Artificial sequence
  specific aptamers
gguagagguguggugcggug

SEQ ID NO: 5214 - RNA, 20 nt, Artificial sequence
  specific aptamers
gguagaggugugguguggag

SEQ ID NO: 5215 - RNA, 20 nt, Artificial sequence
  specific aptamers
gguagaggugugguguggcg

SEQ ID NO: 5216 - RNA, 20 nt, Artificial sequence
  specific aptamers
gguagaggugugguguggug

SEQ ID NO: 5217 - RNA, 21 nt, Artificial sequence
  specific aptamers
gguaguggagaggaagaggag

SEQ ID NO: 5218 - RNA, 21 nt, Artificial sequence
  specific aptamers
gguaguggagaggaagaggcg

SEQ ID NO: 5219 - RNA, 21 nt, Artificial sequence
  specific aptamers
gguaguggagaggaagaggug

SEQ ID NO: 5220 - RNA, 21 nt, Artificial sequence
  specific aptamers
gguaguggagaggaagcggag

SEQ ID NO: 5221 - RNA, 21 nt, Artificial sequence
  specific aptamers
gguaguggagaggaagcggcg

SEQ ID NO: 5222 - RNA, 21 nt, Artificial sequence
  specific aptamers
gguaguggagaggaagcggug

SEQ ID NO: 5223 - RNA, 21 nt, Artificial sequence
  specific aptamers
gguaguggagaggaaguggag

SEQ ID NO: 5224 - RNA, 21 nt, Artificial sequence
  specific aptamers
gguaguggagaggaaguggcg

SEQ ID NO: 5225 - RNA, 21 nt, Artificial sequence
  specific aptamers
gguaguggagaggaaguggug

SEQ ID NO: 5226 - RNA, 21 nt, Artificial sequence
  specific aptamers
gguaguggagaggaugaggag

SEQ ID NO: 5227 - RNA, 21 nt, Artificial sequence
  specific aptamers
gguaguggagaggaugaggcg

SEQ ID NO: 5228 - RNA, 21 nt, Artificial sequence
  specific aptamers
gguaguggagaggaugaggug

SEQ ID NO: 5229 - RNA, 21 nt, Artificial sequence
  specific aptamers
gguaguggagaggaugcggag

SEQ ID NO: 5230 - RNA, 21 nt, Artificial sequence
  specific aptamers
gguaguggagaggaugcggcg

SEQ ID NO: 5231 - RNA, 21 nt, Artificial sequence
  specific aptamers
gguaguggagaggaugcggug

SEQ ID NO: 5232 - RNA, 21 nt, Artificial sequence
  specific aptamers
gguaguggagaggauguggag

SEQ ID NO: 5233 - RNA, 21 nt, Artificial sequence
  specific aptamers
gguaguggagaggauguggcg

SEQ ID NO: 5234 - RNA, 21 nt, Artificial sequence
  specific aptamers
gguaguggagaggauguggug

SEQ ID NO: 5235 - RNA, 20 nt, Artificial sequence
  specific aptamers
gguaguggagaggagaggag

SEQ ID NO: 5236 - RNA, 20 nt, Artificial sequence
  specific aptamers
gguaguggagaggagaggcg

SEQ ID NO: 5237 - RNA, 20 nt, Artificial sequence
  specific aptamers
gguaguggagaggagaggug

SEQ ID NO: 5238 - RNA, 20 nt, Artificial sequence
  specific aptamers
gguaguggagaggagcggag

SEQ ID NO: 5239 - RNA, 20 nt, Artificial sequence
  specific aptamers
gguaguggagaggagcggcg

SEQ ID NO: 5240 - RNA, 20 nt, Artificial sequence
  specific aptamers
gguaguggagaggagcggug

SEQ ID NO: 5241 - RNA, 20 nt, Artificial sequence
  specific aptamers
gguaguggagaggaguggag

SEQ ID NO: 5242 - RNA, 20 nt, Artificial sequence
  specific aptamers
gguaguggagaggaguggcg

SEQ ID NO: 5243 - RNA, 20 nt, Artificial sequence
  specific aptamers
gguaguggagaggaguggug

SEQ ID NO: 5244 - RNA, 21 nt, Artificial sequence
  specific aptamers
gguaguggagagguagaggag

SEQ ID NO: 5245 - RNA, 21 nt, Artificial sequence
  specific aptamers
gguaguggagagguagaggcg

SEQ ID NO: 5246 - RNA, 21 nt, Artificial sequence
  specific aptamers
gguaguggagagguagaggug

SEQ ID NO: 5247 - RNA, 21 nt, Artificial sequence
  specific aptamers
gguaguggagagguagcggag

SEQ ID NO: 5248 - RNA, 21 nt, Artificial sequence
  specific aptamers
gguaguggagagguagcggcg

SEQ ID NO: 5249 - RNA, 21 nt, Artificial sequence
  specific aptamers
gguaguggagagguagcggug

SEQ ID NO: 5250 - RNA, 21 nt, Artificial sequence
  specific aptamers
gguaguggagagguaguggag

SEQ ID NO: 5251 - RNA, 21 nt, Artificial sequence
  specific aptamers
gguaguggagagguaguggcg

SEQ ID NO: 5252 - RNA, 21 nt, Artificial sequence
  specific aptamers
gguaguggagagguaguggug

SEQ ID NO: 5253 - RNA, 21 nt, Artificial sequence
  specific aptamers
gguaguggagagguugaggag

SEQ ID NO: 5254 - RNA, 21 nt, Artificial sequence
  specific aptamers
gguaguggagagguugaggcg

SEQ ID NO: 5255 - RNA, 21 nt, Artificial sequence
  specific aptamers
gguaguggagagguugaggug

SEQ ID NO: 5256 - RNA, 21 nt, Artificial sequence
  specific aptamers
gguaguggagagguugcggag

SEQ ID NO: 5257 - RNA, 21 nt, Artificial sequence
  specific aptamers
gguaguggagagguugcggcg

SEQ ID NO: 5258 - RNA, 21 nt, Artificial sequence
  specific aptamers
gguaguggagagguugcggug

SEQ ID NO: 5259 - RNA, 21 nt, Artificial sequence
  specific aptamers
gguaguggagagguuguggag

SEQ ID NO: 5260 - RNA, 21 nt, Artificial sequence
  specific aptamers
gguaguggagagguuguggcg

SEQ ID NO: 5261 - RNA, 21 nt, Artificial sequence
  specific aptamers
gguaguggagagguuguggug

SEQ ID NO: 5262 - RNA, 20 nt, Artificial sequence
  specific aptamers
gguaguggagaggugaggag

SEQ ID NO: 5263 - RNA, 20 nt, Artificial sequence
  specific aptamers
gguaguggagaggugaggcg

SEQ ID NO: 5264 - RNA, 20 nt, Artificial sequence
  specific aptamers
gguaguggagaggugaggug

SEQ ID NO: 5265 - RNA, 20 nt, Artificial sequence
  specific aptamers
gguaguggagaggugcggag

SEQ ID NO: 5266 - RNA, 20 nt, Artificial sequence
  specific aptamers
gguaguggagaggugcggcg

SEQ ID NO: 5267 - RNA, 20 nt, Artificial sequence
  specific aptamers
gguaguggagaggugcggug

SEQ ID NO: 5268 - RNA, 20 nt, Artificial sequence
  specific aptamers
gguaguggagagguguggag

SEQ ID NO: 5269 - RNA, 20 nt, Artificial sequence
  specific aptamers
gguaguggagagguguggcg

SEQ ID NO: 5270 - RNA, 20 nt, Artificial sequence
  specific aptamers
gguaguggagagguguggug

SEQ ID NO: 5271 - RNA, 21 nt, Artificial sequence
  specific aptamers
gguaguggaguggaagaggag

SEQ ID NO: 5272 - RNA, 21 nt, Artificial sequence
  specific aptamers
gguaguggaguggaagaggcg

SEQ ID NO: 5273 - RNA, 21 nt, Artificial sequence
  specific aptamers
gguaguggaguggaagaggug

SEQ ID NO: 5274 - RNA, 21 nt, Artificial sequence
  specific aptamers
gguaguggaguggaagcggag

SEQ ID NO: 5275 - RNA, 21 nt, Artificial sequence
  specific aptamers
gguaguggaguggaagcggcg

SEQ ID NO: 5276 - RNA, 21 nt, Artificial sequence
  specific aptamers
gguaguggaguggaagcggug

SEQ ID NO: 5277 - RNA, 21 nt, Artificial sequence
  specific aptamers
gguaguggaguggaaguggag

SEQ ID NO: 5278 - RNA, 21 nt, Artificial sequence
  specific aptamers
gguaguggaguggaaguggcg

SEQ ID NO: 5279 - RNA, 21 nt, Artificial sequence
  specific aptamers
gguaguggaguggaaguggug

SEQ ID NO: 5280 - RNA, 21 nt, Artificial sequence
  specific aptamers
gguaguggaguggaugaggag

SEQ ID NO: 5281 - RNA, 21 nt, Artificial sequence
  specific aptamers
gguaguggaguggaugaggcg

SEQ ID NO: 5282 - RNA, 21 nt, Artificial sequence
  specific aptamers
gguaguggaguggaugaggug

SEQ ID NO: 5283 - RNA, 21 nt, Artificial sequence
  specific aptamers
gguaguggaguggaugcggag

SEQ ID NO: 5284 - RNA, 21 nt, Artificial sequence
  specific aptamers
gguaguggaguggaugcggcg

SEQ ID NO: 5285 - RNA, 21 nt, Artificial sequence
  specific aptamers
gguaguggaguggaugcggug

SEQ ID NO: 5286 - RNA, 21 nt, Artificial sequence
  specific aptamers
gguaguggaguggauguggag

SEQ ID NO: 5287 - RNA, 21 nt, Artificial sequence
  specific aptamers
gguaguggaguggauguggcg

SEQ ID NO: 5288 - RNA, 21 nt, Artificial sequence
  specific aptamers
gguaguggaguggauguggug

SEQ ID NO: 5289 - RNA, 20 nt, Artificial sequence
  specific aptamers
gguaguggaguggagaggag

SEQ ID NO: 5290 - RNA, 20 nt, Artificial sequence
  specific aptamers
gguaguggaguggagaggcg

SEQ ID NO: 5291 - RNA, 20 nt, Artificial sequence
  specific aptamers
gguaguggaguggagaggug

SEQ ID NO: 5292 - RNA, 20 nt, Artificial sequence
  specific aptamers
gguaguggaguggagcggag

SEQ ID NO: 5293 - RNA, 20 nt, Artificial sequence
  specific aptamers
gguaguggaguggagcggcg

SEQ ID NO: 5294 - RNA, 20 nt, Artificial sequence
  specific aptamers
gguaguggaguggagcggug

SEQ ID NO: 5295 - RNA, 20 nt, Artificial sequence
  specific aptamers
gguaguggaguggaguggag

SEQ ID NO: 5296 - RNA, 20 nt, Artificial sequence
  specific aptamers
gguaguggaguggaguggcg

SEQ ID NO: 5297 - RNA, 20 nt, Artificial sequence
  specific aptamers
gguaguggaguggaguggug

SEQ ID NO: 5298 - RNA, 21 nt, Artificial sequence
  specific aptamers
gguaguggagugguagaggag

SEQ ID NO: 5299 - RNA, 21 nt, Artificial sequence
  specific aptamers
gguaguggagugguagaggcg

SEQ ID NO: 5300 - RNA, 21 nt, Artificial sequence
  specific aptamers
gguaguggagugguagaggug

SEQ ID NO: 5301 - RNA, 21 nt, Artificial sequence
  specific aptamers
gguaguggagugguagcggag

SEQ ID NO: 5302 - RNA, 21 nt, Artificial sequence
  specific aptamers
gguaguggagugguagcggcg

SEQ ID NO: 5303 - RNA, 21 nt, Artificial sequence
  specific aptamers
gguaguggagugguagcggug

SEQ ID NO: 5304 - RNA, 21 nt, Artificial sequence
  specific aptamers
gguaguggagugguaguggag

SEQ ID NO: 5305 - RNA, 21 nt, Artificial sequence
  specific aptamers
gguaguggagugguaguggcg

SEQ ID NO: 5306 - RNA, 21 nt, Artificial sequence
  specific aptamers
gguaguggagugguaguggug

SEQ ID NO: 5307 - RNA, 21 nt, Artificial sequence
  specific aptamers
gguaguggagugguugaggag

SEQ ID NO: 5308 - RNA, 21 nt, Artificial sequence
  specific aptamers
gguaguggagugguugaggcg

SEQ ID NO: 5309 - RNA, 21 nt, Artificial sequence
  specific aptamers
gguaguggagugguugaggug

SEQ ID NO: 5310 - RNA, 21 nt, Artificial sequence
  specific aptamers
gguaguggagugguugcggag

SEQ ID NO: 5311 - RNA, 21 nt, Artificial sequence
  specific aptamers
gguaguggagugguugcggcg

SEQ ID NO: 5312 - RNA, 21 nt, Artificial sequence
  specific aptamers
gguaguggagugguugcggug

SEQ ID NO: 5313 - RNA, 21 nt, Artificial sequence
  specific aptamers
gguaguggagugguuguggag

SEQ ID NO: 5314 - RNA, 21 nt, Artificial sequence
  specific aptamers
gguaguggagugguuguggcg

SEQ ID NO: 5315 - RNA, 21 nt, Artificial sequence
  specific aptamers
gguaguggagugguuguggug

SEQ ID NO: 5316 - RNA, 20 nt, Artificial sequence
  specific aptamers
gguaguggaguggugaggag

SEQ ID NO: 5317 - RNA, 20 nt, Artificial sequence
  specific aptamers
gguaguggaguggugaggcg

SEQ ID NO: 5318 - RNA, 20 nt, Artificial sequence
  specific aptamers
gguaguggaguggugaggug

SEQ ID NO: 5319 - RNA, 20 nt, Artificial sequence
  specific aptamers
gguaguggaguggugcggag

SEQ ID NO: 5320 - RNA, 20 nt, Artificial sequence
  specific aptamers
gguaguggaguggugcggcg

SEQ ID NO: 5321 - RNA, 20 nt, Artificial sequence
  specific aptamers
gguaguggaguggugcggug

SEQ ID NO: 5322 - RNA, 20 nt, Artificial sequence
  specific aptamers
gguaguggagugguguggag

SEQ ID NO: 5323 - RNA, 20 nt, Artificial sequence
  specific aptamers
gguaguggagugguguggcg

SEQ ID NO: 5324 - RNA, 20 nt, Artificial sequence
  specific aptamers
gguaguggagugguguggug

SEQ ID NO: 5325 - RNA, 21 nt, Artificial sequence
  specific aptamers
gguaguggugaggaagaggag

SEQ ID NO: 5326 - RNA, 21 nt, Artificial sequence
  specific aptamers
gguaguggugaggaagaggcg

SEQ ID NO: 5327 - RNA, 21 nt, Artificial sequence
  specific aptamers
gguaguggugaggaagaggug

SEQ ID NO: 5328 - RNA, 21 nt, Artificial sequence
  specific aptamers
gguaguggugaggaagcggag

SEQ ID NO: 5329 - RNA, 21 nt, Artificial sequence
  specific aptamers
gguaguggugaggaagcggcg

SEQ ID NO: 5330 - RNA, 21 nt, Artificial sequence
  specific aptamers
gguaguggugaggaagcggug

SEQ ID NO: 5331 - RNA, 21 nt, Artificial sequence
  specific aptamers
gguaguggugaggaaguggag

SEQ ID NO: 5332 - RNA, 21 nt, Artificial sequence
  specific aptamers
gguaguggugaggaaguggcg

SEQ ID NO: 5333 - RNA, 21 nt, Artificial sequence
  specific aptamers
gguaguggugaggaaguggug

SEQ ID NO: 5334 - RNA, 21 nt, Artificial sequence
  specific aptamers
gguaguggugaggaugaggag

SEQ ID NO: 5335 - RNA, 21 nt, Artificial sequence
  specific aptamers
gguaguggugaggaugaggcg

SEQ ID NO: 5336 - RNA, 21 nt, Artificial sequence
  specific aptamers
gguaguggugaggaugaggug

SEQ ID NO: 5337 - RNA, 21 nt, Artificial sequence
  specific aptamers
gguaguggugaggaugcggag

SEQ ID NO: 5338 - RNA, 21 nt, Artificial sequence
  specific aptamers
gguaguggugaggaugcggcg

SEQ ID NO: 5339 - RNA, 21 nt, Artificial sequence
  specific aptamers
gguaguggugaggaugcggug

SEQ ID NO: 5340 - RNA, 21 nt, Artificial sequence
  specific aptamers
gguaguggugaggauguggag

SEQ ID NO: 5341 - RNA, 21 nt, Artificial sequence
  specific aptamers
gguaguggugaggauguggcg

SEQ ID NO: 5342 - RNA, 21 nt, Artificial sequence
  specific aptamers
gguaguggugaggauguggug

SEQ ID NO: 5343 - RNA, 20 nt, Artificial sequence
  specific aptamers
gguaguggugaggagaggag

SEQ ID NO: 5344 - RNA, 20 nt, Artificial sequence
  specific aptamers
gguaguggugaggagaggcg

SEQ ID NO: 5345 - RNA, 20 nt, Artificial sequence
  specific aptamers
gguaguggugaggagaggug

SEQ ID NO: 5346 - RNA, 20 nt, Artificial sequence
  specific aptamers
gguaguggugaggagcggag

SEQ ID NO: 5347 - RNA, 20 nt, Artificial sequence
  specific aptamers
gguaguggugaggagcggcg

SEQ ID NO: 5348 - RNA, 20 nt, Artificial sequence
  specific aptamers
gguaguggugaggagcggug

SEQ ID NO: 5349 - RNA, 20 nt, Artificial sequence
  specific aptamers
gguaguggugaggaguggag

SEQ ID NO: 5350 - RNA, 20 nt, Artificial sequence
  specific aptamers
gguaguggugaggaguggcg

SEQ ID NO: 5351 - RNA, 20 nt, Artificial sequence
  specific aptamers
gguaguggugaggaguggug

SEQ ID NO: 5352 - RNA, 21 nt, Artificial sequence
  specific aptamers
gguaguggugagguagaggag

SEQ ID NO: 5353 - RNA, 21 nt, Artificial sequence
  specific aptamers
gguaguggugagguagaggcg

SEQ ID NO: 5354 - RNA, 21 nt, Artificial sequence
  specific aptamers
gguaguggugagguagaggug

SEQ ID NO: 5355 - RNA, 21 nt, Artificial sequence
  specific aptamers
gguaguggugagguagcggag

SEQ ID NO: 5356 - RNA, 21 nt, Artificial sequence
  specific aptamers
gguaguggugagguagcggcg

SEQ ID NO: 5357 - RNA, 21 nt, Artificial sequence
  specific aptamers
gguaguggugagguagcggug

SEQ ID NO: 5358 - RNA, 21 nt, Artificial sequence
  specific aptamers
gguaguggugagguaguggag

SEQ ID NO: 5359 - RNA, 21 nt, Artificial sequence
  specific aptamers
gguaguggugagguaguggcg

SEQ ID NO: 5360 - RNA, 21 nt, Artificial sequence
  specific aptamers
gguaguggugagguaguggug

SEQ ID NO: 5361 - RNA, 21 nt, Artificial sequence
  specific aptamers
gguaguggugagguugaggag

SEQ ID NO: 5362 - RNA, 21 nt, Artificial sequence
  specific aptamers
gguaguggugagguugaggcg

SEQ ID NO: 5363 - RNA, 21 nt, Artificial sequence
  specific aptamers
gguaguggugagguugaggug

SEQ ID NO: 5364 - RNA, 21 nt, Artificial sequence
  specific aptamers
gguaguggugagguugcggag

SEQ ID NO: 5365 - RNA, 21 nt, Artificial sequence
  specific aptamers
gguaguggugagguugcggcg

SEQ ID NO: 5366 - RNA, 21 nt, Artificial sequence
  specific aptamers
gguaguggugagguugcggug

SEQ ID NO: 5367 - RNA, 21 nt, Artificial sequence
  specific aptamers
gguaguggugagguuguggag

SEQ ID NO: 5368 - RNA, 21 nt, Artificial sequence
  specific aptamers
gguaguggugagguuguggcg

SEQ ID NO: 5369 - RNA, 21 nt, Artificial sequence
  specific aptamers
gguaguggugagguuguggug

SEQ ID NO: 5370 - RNA, 20 nt, Artificial sequence
  specific aptamers
gguaguggugaggugaggag

SEQ ID NO: 5371 - RNA, 20 nt, Artificial sequence
  specific aptamers
gguaguggugaggugaggcg

SEQ ID NO: 5372 - RNA, 20 nt, Artificial sequence
  specific aptamers
gguaguggugaggugaggug

SEQ ID NO: 5373 - RNA, 20 nt, Artificial sequence
  specific aptamers
gguaguggugaggugcggag

SEQ ID NO: 5374 - RNA, 20 nt, Artificial sequence
  specific aptamers
gguaguggugaggugcggcg

SEQ ID NO: 5375 - RNA, 20 nt, Artificial sequence
  specific aptamers
gguaguggugaggugcggug

SEQ ID NO: 5376 - RNA, 20 nt, Artificial sequence
  specific aptamers
gguaguggugagguguggag

SEQ ID NO: 5377 - RNA, 20 nt, Artificial sequence
  specific aptamers
gguaguggugagguguggcg

SEQ ID NO: 5378 - RNA, 20 nt, Artificial sequence
  specific aptamers
gguaguggugagguguggug

SEQ ID NO: 5379 - RNA, 21 nt, Artificial sequence
  specific aptamers
gguagugguguggaagaggag

SEQ ID NO: 5380 - RNA, 21 nt, Artificial sequence
  specific aptamers
gguagugguguggaagaggcg

SEQ ID NO: 5381 - RNA, 21 nt, Artificial sequence
  specific aptamers
gguagugguguggaagaggug

SEQ ID NO: 5382 - RNA, 21 nt, Artificial sequence
  specific aptamers
gguagugguguggaagcggag

SEQ ID NO: 5383 - RNA, 21 nt, Artificial sequence
  specific aptamers
gguagugguguggaagcggcg

SEQ ID NO: 5384 - RNA, 21 nt, Artificial sequence
  specific aptamers
gguagugguguggaagcggug

SEQ ID NO: 5385 - RNA, 21 nt, Artificial sequence
  specific aptamers
gguagugguguggaaguggag

SEQ ID NO: 5386 - RNA, 21 nt, Artificial sequence
  specific aptamers
gguagugguguggaaguggcg

SEQ ID NO: 5387 - RNA, 21 nt, Artificial sequence
  specific aptamers
gguagugguguggaaguggug

SEQ ID NO: 5388 - RNA, 21 nt, Artificial sequence
  specific aptamers
gguagugguguggaugaggag

SEQ ID NO: 5389 - RNA, 21 nt, Artificial sequence
  specific aptamers
gguagugguguggaugaggcg

SEQ ID NO: 5390 - RNA, 21 nt, Artificial sequence
  specific aptamers
gguagugguguggaugaggug

SEQ ID NO: 5391 - RNA, 21 nt, Artificial sequence
  specific aptamers
gguagugguguggaugcggag

SEQ ID NO: 5392 - RNA, 21 nt, Artificial sequence
  specific aptamers
gguagugguguggaugcggcg

SEQ ID NO: 5393 - RNA, 21 nt, Artificial sequence
  specific aptamers
gguagugguguggaugcggug

SEQ ID NO: 5394 - RNA, 21 nt, Artificial sequence
  specific aptamers
gguagugguguggauguggag

SEQ ID NO: 5395 - RNA, 21 nt, Artificial sequence
  specific aptamers
gguagugguguggauguggcg

SEQ ID NO: 5396 - RNA, 21 nt, Artificial sequence
  specific aptamers
gguagugguguggauguggug

SEQ ID NO: 5397 - RNA, 20 nt, Artificial sequence
  specific aptamers
gguagugguguggagaggag

SEQ ID NO: 5398 - RNA, 20 nt, Artificial sequence
  specific aptamers
gguagugguguggagaggcg

SEQ ID NO: 5399 - RNA, 20 nt, Artificial sequence
  specific aptamers
gguagugguguggagaggug

SEQ ID NO: 5400 - RNA, 20 nt, Artificial sequence
  specific aptamers
gguagugguguggagcggag

SEQ ID NO: 5401 - RNA, 20 nt, Artificial sequence
  specific aptamers
gguagugguguggagcggcg

SEQ ID NO: 5402 - RNA, 20 nt, Artificial sequence
  specific aptamers
gguagugguguggagcggug

SEQ ID NO: 5403 - RNA, 20 nt, Artificial sequence
  specific aptamers
gguagugguguggaguggag

SEQ ID NO: 5404 - RNA, 20 nt, Artificial sequence
  specific aptamers
gguagugguguggaguggcg

SEQ ID NO: 5405 - RNA, 20 nt, Artificial sequence
  specific aptamers
gguagugguguggaguggug

SEQ ID NO: 5406 - RNA, 21 nt, Artificial sequence
  specific aptamers
gguaguggugugguagaggag

SEQ ID NO: 5407 - RNA, 21 nt, Artificial sequence
  specific aptamers
gguaguggugugguagaggcg

SEQ ID NO: 5408 - RNA, 21 nt, Artificial sequence
  specific aptamers
gguaguggugugguagaggug

SEQ ID NO: 5409 - RNA, 21 nt, Artificial sequence
  specific aptamers
gguaguggugugguagcggag

SEQ ID NO: 5410 - RNA, 21 nt, Artificial sequence
  specific aptamers
gguaguggugugguagcggcg

SEQ ID NO: 5411 - RNA, 21 nt, Artificial sequence
  specific aptamers
gguaguggugugguagcggug

SEQ ID NO: 5412 - RNA, 21 nt, Artificial sequence
  specific aptamers
gguaguggugugguaguggag

SEQ ID NO: 5413 - RNA, 21 nt, Artificial sequence
  specific aptamers
gguaguggugugguaguggcg

SEQ ID NO: 5414 - RNA, 21 nt, Artificial sequence
  specific aptamers
gguaguggugugguaguggug

SEQ ID NO: 5415 - RNA, 21 nt, Artificial sequence
  specific aptamers
gguaguggugugguugaggag

SEQ ID NO: 5416 - RNA, 21 nt, Artificial sequence
  specific aptamers
gguaguggugugguugaggcg

SEQ ID NO: 5417 - RNA, 21 nt, Artificial sequence
  specific aptamers
gguaguggugugguugaggug

SEQ ID NO: 5418 - RNA, 21 nt, Artificial sequence
  specific aptamers
gguaguggugugguugcggag

SEQ ID NO: 5419 - RNA, 21 nt, Artificial sequence
  specific aptamers
gguaguggugugguugcggcg

SEQ ID NO: 5420 - RNA, 21 nt, Artificial sequence
  specific aptamers
gguaguggugugguugcggug

SEQ ID NO: 5421 - RNA, 21 nt, Artificial sequence
  specific aptamers
gguaguggugugguuguggag

SEQ ID NO: 5422 - RNA, 21 nt, Artificial sequence
  specific aptamers
gguaguggugugguuguggcg

SEQ ID NO: 5423 - RNA, 21 nt, Artificial sequence
  specific aptamers
gguaguggugugguuguggug

SEQ ID NO: 5424 - RNA, 20 nt, Artificial sequence
  specific aptamers
gguagugguguggugaggag

SEQ ID NO: 5425 - RNA, 20 nt, Artificial sequence
  specific aptamers
gguagugguguggugaggcg

SEQ ID NO: 5426 - RNA, 20 nt, Artificial sequence
  specific aptamers
gguagugguguggugaggug

SEQ ID NO: 5427 - RNA, 20 nt, Artificial sequence
  specific aptamers
gguagugguguggugcggag

SEQ ID NO: 5428 - RNA, 20 nt, Artificial sequence
  specific aptamers
gguagugguguggugcggcg

SEQ ID NO: 5429 - RNA, 20 nt, Artificial sequence
  specific aptamers
gguagugguguggugcggug

SEQ ID NO: 5430 - RNA, 20 nt, Artificial sequence
  specific aptamers
gguaguggugugguguggag

SEQ ID NO: 5431 - RNA, 20 nt, Artificial sequence
  specific aptamers
gguaguggugugguguggcg

SEQ ID NO: 5432 - RNA, 20 nt, Artificial sequence
  specific aptamers
gguaguggugugguguggug

SEQ ID NO: 5433 - RNA, 21 nt, Artificial sequence
  specific aptamers
gguugaggagaggaagaggag

SEQ ID NO: 5434 - RNA, 21 nt, Artificial sequence
  specific aptamers
gguugaggagaggaagaggcg

SEQ ID NO: 5435 - RNA, 21 nt, Artificial sequence
  specific aptamers
gguugaggagaggaagaggug

SEQ ID NO: 5436 - RNA, 21 nt, Artificial sequence
  specific aptamers
gguugaggagaggaagcggag

SEQ ID NO: 5437 - RNA, 21 nt, Artificial sequence
  specific aptamers
gguugaggagaggaagcggcg

SEQ ID NO: 5438 - RNA, 21 nt, Artificial sequence
  specific aptamers
gguugaggagaggaagcggug

SEQ ID NO: 5439 - RNA, 21 nt, Artificial sequence
  specific aptamers
gguugaggagaggaaguggag

SEQ ID NO: 5440 - RNA, 21 nt, Artificial sequence
  specific aptamers
gguugaggagaggaaguggcg

SEQ ID NO: 5441 - RNA, 21 nt, Artificial sequence
  specific aptamers
gguugaggagaggaaguggug

SEQ ID NO: 5442 - RNA, 21 nt, Artificial sequence
  specific aptamers
gguugaggagaggaugaggag

SEQ ID NO: 5443 - RNA, 21 nt, Artificial sequence
  specific aptamers
gguugaggagaggaugaggcg

SEQ ID NO: 5444 - RNA, 21 nt, Artificial sequence
  specific aptamers
gguugaggagaggaugaggug

SEQ ID NO: 5445 - RNA, 21 nt, Artificial sequence
  specific aptamers
gguugaggagaggaugcggag

SEQ ID NO: 5446 - RNA, 21 nt, Artificial sequence
  specific aptamers
gguugaggagaggaugcggcg

SEQ ID NO: 5447 - RNA, 21 nt, Artificial sequence
  specific aptamers
gguugaggagaggaugcggug

SEQ ID NO: 5448 - RNA, 21 nt, Artificial sequence
  specific aptamers
gguugaggagaggauguggag

SEQ ID NO: 5449 - RNA, 21 nt, Artificial sequence
  specific aptamers
gguugaggagaggauguggcg

SEQ ID NO: 5450 - RNA, 21 nt, Artificial sequence
  specific aptamers
gguugaggagaggauguggug

SEQ ID NO: 5451 - RNA, 20 nt, Artificial sequence
  specific aptamers
gguugaggagaggagaggag

SEQ ID NO: 5452 - RNA, 20 nt, Artificial sequence
  specific aptamers
gguugaggagaggagaggcg

SEQ ID NO: 5453 - RNA, 20 nt, Artificial sequence
  specific aptamers
gguugaggagaggagaggug

SEQ ID NO: 5454 - RNA, 20 nt, Artificial sequence
  specific aptamers
gguugaggagaggagcggag

SEQ ID NO: 5455 - RNA, 20 nt, Artificial sequence
  specific aptamers
gguugaggagaggagcggcg

SEQ ID NO: 5456 - RNA, 20 nt, Artificial sequence
  specific aptamers
gguugaggagaggagcggug

SEQ ID NO: 5457 - RNA, 20 nt, Artificial sequence
  specific aptamers
gguugaggagaggaguggag

SEQ ID NO: 5458 - RNA, 20 nt, Artificial sequence
  specific aptamers
gguugaggagaggaguggcg

SEQ ID NO: 5459 - RNA, 20 nt, Artificial sequence
  specific aptamers
gguugaggagaggaguggug

SEQ ID NO: 5460 - RNA, 21 nt, Artificial sequence
  specific aptamers
gguugaggagagguagaggag

SEQ ID NO: 5461 - RNA, 21 nt, Artificial sequence
  specific aptamers
gguugaggagagguagaggcg

SEQ ID NO: 5462 - RNA, 21 nt, Artificial sequence
  specific aptamers
gguugaggagagguagaggug

SEQ ID NO: 5463 - RNA, 21 nt, Artificial sequence
  specific aptamers
gguugaggagagguagcggag

SEQ ID NO: 5464 - RNA, 21 nt, Artificial sequence
  specific aptamers
gguugaggagagguagcggcg

SEQ ID NO: 5465 - RNA, 21 nt, Artificial sequence
  specific aptamers
gguugaggagagguagcggug

SEQ ID NO: 5466 - RNA, 21 nt, Artificial sequence
  specific aptamers
gguugaggagagguaguggag

SEQ ID NO: 5467 - RNA, 21 nt, Artificial sequence
  specific aptamers
gguugaggagagguaguggcg

SEQ ID NO: 5468 - RNA, 21 nt, Artificial sequence
  specific aptamers
gguugaggagagguaguggug

SEQ ID NO: 5469 - RNA, 21 nt, Artificial sequence
  specific aptamers
gguugaggagagguugaggag

SEQ ID NO: 5470 - RNA, 21 nt, Artificial sequence
  specific aptamers
gguugaggagagguugaggcg

SEQ ID NO: 5471 - RNA, 21 nt, Artificial sequence
  specific aptamers
gguugaggagagguugaggug

SEQ ID NO: 5472 - RNA, 21 nt, Artificial sequence
  specific aptamers
gguugaggagagguugcggag

SEQ ID NO: 5473 - RNA, 21 nt, Artificial sequence
  specific aptamers
gguugaggagagguugcggcg

SEQ ID NO: 5474 - RNA, 21 nt, Artificial sequence
  specific aptamers
gguugaggagagguugcggug

SEQ ID NO: 5475 - RNA, 21 nt, Artificial sequence
  specific aptamers
gguugaggagagguuguggag

SEQ ID NO: 5476 - RNA, 21 nt, Artificial sequence
  specific aptamers
gguugaggagagguuguggcg

SEQ ID NO: 5477 - RNA, 21 nt, Artificial sequence
  specific aptamers
gguugaggagagguuguggug

SEQ ID NO: 5478 - RNA, 20 nt, Artificial sequence
  specific aptamers
gguugaggagaggugaggag

SEQ ID NO: 5479 - RNA, 20 nt, Artificial sequence
  specific aptamers
gguugaggagaggugaggcg

SEQ ID NO: 5480 - RNA, 20 nt, Artificial sequence
  specific aptamers
gguugaggagaggugaggug

SEQ ID NO: 5481 - RNA, 20 nt, Artificial sequence
  specific aptamers
gguugaggagaggugcggag

SEQ ID NO: 5482 - RNA, 20 nt, Artificial sequence
  specific aptamers
gguugaggagaggugcggcg

SEQ ID NO: 5483 - RNA, 20 nt, Artificial sequence
  specific aptamers
gguugaggagaggugcggug

SEQ ID NO: 5484 - RNA, 20 nt, Artificial sequence
  specific aptamers
gguugaggagagguguggag

SEQ ID NO: 5485 - RNA, 20 nt, Artificial sequence
  specific aptamers
gguugaggagagguguggcg

SEQ ID NO: 5486 - RNA, 20 nt, Artificial sequence
  specific aptamers
gguugaggagagguguggug

SEQ ID NO: 5487 - RNA, 21 nt, Artificial sequence
  specific aptamers
gguugaggaguggaagaggag

SEQ ID NO: 5488 - RNA, 21 nt, Artificial sequence
  specific aptamers
gguugaggaguggaagaggcg

SEQ ID NO: 5489 - RNA, 21 nt, Artificial sequence
  specific aptamers
gguugaggaguggaagaggug

SEQ ID NO: 5490 - RNA, 21 nt, Artificial sequence
  specific aptamers
gguugaggaguggaagcggag

SEQ ID NO: 5491 - RNA, 21 nt, Artificial sequence
  specific aptamers
gguugaggaguggaagcggcg

SEQ ID NO: 5492 - RNA, 21 nt, Artificial sequence
  specific aptamers
gguugaggaguggaagcggug

SEQ ID NO: 5493 - RNA, 21 nt, Artificial sequence
  specific aptamers
gguugaggaguggaaguggag

SEQ ID NO: 5494 - RNA, 21 nt, Artificial sequence
  specific aptamers
gguugaggaguggaaguggcg

SEQ ID NO: 5495 - RNA, 21 nt, Artificial sequence
  specific aptamers
gguugaggaguggaaguggug

SEQ ID NO: 5496 - RNA, 21 nt, Artificial sequence
  specific aptamers
gguugaggaguggaugaggag

SEQ ID NO: 5497 - RNA, 21 nt, Artificial sequence
  specific aptamers
gguugaggaguggaugaggcg

SEQ ID NO: 5498 - RNA, 21 nt, Artificial sequence
  specific aptamers
gguugaggaguggaugaggug

SEQ ID NO: 5499 - RNA, 21 nt, Artificial sequence
  specific aptamers
gguugaggaguggaugcggag

SEQ ID NO: 5500 - RNA, 21 nt, Artificial sequence
  specific aptamers
gguugaggaguggaugcggcg

SEQ ID NO: 5501 - RNA, 21 nt, Artificial sequence
  specific aptamers
gguugaggaguggaugcggug

SEQ ID NO: 5502 - RNA, 21 nt, Artificial sequence
  specific aptamers
gguugaggaguggauguggag

SEQ ID NO: 5503 - RNA, 21 nt, Artificial sequence
  specific aptamers
gguugaggaguggauguggcg

SEQ ID NO: 5504 - RNA, 21 nt, Artificial sequence
  specific aptamers
gguugaggaguggauguggug

SEQ ID NO: 5505 - RNA, 20 nt, Artificial sequence
  specific aptamers
gguugaggaguggagaggag

SEQ ID NO: 5506 - RNA, 20 nt, Artificial sequence
  specific aptamers
gguugaggaguggagaggcg

SEQ ID NO: 5507 - RNA, 20 nt, Artificial sequence
  specific aptamers
gguugaggaguggagaggug

SEQ ID NO: 5508 - RNA, 20 nt, Artificial sequence
  specific aptamers
gguugaggaguggagcggag

SEQ ID NO: 5509 - RNA, 20 nt, Artificial sequence
  specific aptamers
gguugaggaguggagcggcg

SEQ ID NO: 5510 - RNA, 20 nt, Artificial sequence
  specific aptamers
gguugaggaguggagcggug

SEQ ID NO: 5511 - RNA, 20 nt, Artificial sequence
  specific aptamers
gguugaggaguggaguggag

SEQ ID NO: 5512 - RNA, 20 nt, Artificial sequence
  specific aptamers
gguugaggaguggaguggcg

SEQ ID NO: 5513 - RNA, 20 nt, Artificial sequence
  specific aptamers
gguugaggaguggaguggug

SEQ ID NO: 5514 - RNA, 21 nt, Artificial sequence
  specific aptamers
gguugaggagugguagaggag

SEQ ID NO: 5515 - RNA, 21 nt, Artificial sequence
  specific aptamers
gguugaggagugguagaggcg

SEQ ID NO: 5516 - RNA, 21 nt, Artificial sequence
  specific aptamers
gguugaggagugguagaggug

SEQ ID NO: 5517 - RNA, 21 nt, Artificial sequence
  specific aptamers
gguugaggagugguagcggag

SEQ ID NO: 5518 - RNA, 21 nt, Artificial sequence
  specific aptamers
gguugaggagugguagcggcg

SEQ ID NO: 5519 - RNA, 21 nt, Artificial sequence
  specific aptamers
gguugaggagugguagcggug

SEQ ID NO: 5520 - RNA, 21 nt, Artificial sequence
  specific aptamers
gguugaggagugguaguggag

SEQ ID NO: 5521 - RNA, 21 nt, Artificial sequence
  specific aptamers
gguugaggagugguaguggcg

SEQ ID NO: 5522 - RNA, 21 nt, Artificial sequence
  specific aptamers
gguugaggagugguaguggug

SEQ ID NO: 5523 - RNA, 21 nt, Artificial sequence
  specific aptamers
gguugaggagugguugaggag

SEQ ID NO: 5524 - RNA, 21 nt, Artificial sequence
  specific aptamers
gguugaggagugguugaggcg

SEQ ID NO: 5525 - RNA, 21 nt, Artificial sequence
  specific aptamers
gguugaggagugguugaggug

SEQ ID NO: 5526 - RNA, 21 nt, Artificial sequence
  specific aptamers
gguugaggagugguugcggag

SEQ ID NO: 5527 - RNA, 21 nt, Artificial sequence
  specific aptamers
gguugaggagugguugcggcg

SEQ ID NO: 5528 - RNA, 21 nt, Artificial sequence
  specific aptamers
gguugaggagugguugcggug

SEQ ID NO: 5529 - RNA, 21 nt, Artificial sequence
  specific aptamers
gguugaggagugguuguggag

SEQ ID NO: 5530 - RNA, 21 nt, Artificial sequence
  specific aptamers
gguugaggagugguuguggcg

SEQ ID NO: 5531 - RNA, 21 nt, Artificial sequence
  specific aptamers
gguugaggagugguuguggug

SEQ ID NO: 5532 - RNA, 20 nt, Artificial sequence
  specific aptamers
gguugaggaguggugaggag

SEQ ID NO: 5533 - RNA, 20 nt, Artificial sequence
  specific aptamers
gguugaggaguggugaggcg

SEQ ID NO: 5534 - RNA, 20 nt, Artificial sequence
  specific aptamers
gguugaggaguggugaggug

SEQ ID NO: 5535 - RNA, 20 nt, Artificial sequence
  specific aptamers
gguugaggaguggugcggag

SEQ ID NO: 5536 - RNA, 20 nt, Artificial sequence
  specific aptamers
gguugaggaguggugcggcg

SEQ ID NO: 5537 - RNA, 20 nt, Artificial sequence
  specific aptamers
gguugaggaguggugcggug

SEQ ID NO: 5538 - RNA, 20 nt, Artificial sequence
  specific aptamers
gguugaggagugguguggag

SEQ ID NO: 5539 - RNA, 20 nt, Artificial sequence
  specific aptamers
gguugaggagugguguggcg

SEQ ID NO: 5540 - RNA, 20 nt, Artificial sequence
  specific aptamers
gguugaggagugguguggug

SEQ ID NO: 5541 - RNA, 21 nt, Artificial sequence
  specific aptamers
gguugaggugaggaagaggag

SEQ ID NO: 5542 - RNA, 21 nt, Artificial sequence
  specific aptamers
gguugaggugaggaagaggcg

SEQ ID NO: 5543 - RNA, 21 nt, Artificial sequence
  specific aptamers
gguugaggugaggaagaggug

SEQ ID NO: 5544 - RNA, 21 nt, Artificial sequence
  specific aptamers
gguugaggugaggaagcggag

SEQ ID NO: 5545 - RNA, 21 nt, Artificial sequence
  specific aptamers
gguugaggugaggaagcggcg

SEQ ID NO: 5546 - RNA, 21 nt, Artificial sequence
  specific aptamers
gguugaggugaggaagcggug

SEQ ID NO: 5547 - RNA, 21 nt, Artificial sequence
  specific aptamers
gguugaggugaggaaguggag

SEQ ID NO: 5548 - RNA, 21 nt, Artificial sequence
  specific aptamers
gguugaggugaggaaguggcg

SEQ ID NO: 5549 - RNA, 21 nt, Artificial sequence
  specific aptamers
gguugaggugaggaaguggug

SEQ ID NO: 5550 - RNA, 21 nt, Artificial sequence
  specific aptamers
gguugaggugaggaugaggag

SEQ ID NO: 5551 - RNA, 21 nt, Artificial sequence
  specific aptamers
gguugaggugaggaugaggcg

SEQ ID NO: 5552 - RNA, 21 nt, Artificial sequence
  specific aptamers
gguugaggugaggaugaggug

SEQ ID NO: 5553 - RNA, 21 nt, Artificial sequence
  specific aptamers
gguugaggugaggaugcggag

SEQ ID NO: 5554 - RNA, 21 nt, Artificial sequence
  specific aptamers
gguugaggugaggaugcggcg

SEQ ID NO: 5555 - RNA, 21 nt, Artificial sequence
  specific aptamers
gguugaggugaggaugcggug

SEQ ID NO: 5556 - RNA, 21 nt, Artificial sequence
  specific aptamers
gguugaggugaggauguggag

SEQ ID NO: 5557 - RNA, 21 nt, Artificial sequence
  specific aptamers
gguugaggugaggauguggcg

SEQ ID NO: 5558 - RNA, 21 nt, Artificial sequence
  specific aptamers
gguugaggugaggauguggug

SEQ ID NO: 5559 - RNA, 20 nt, Artificial sequence
  specific aptamers
gguugaggugaggagaggag

SEQ ID NO: 5560 - RNA, 20 nt, Artificial sequence
  specific aptamers
gguugaggugaggagaggcg

SEQ ID NO: 5561 - RNA, 20 nt, Artificial sequence
  specific aptamers
gguugaggugaggagaggug

SEQ ID NO: 5562 - RNA, 20 nt, Artificial sequence
  specific aptamers
gguugaggugaggagcggag

SEQ ID NO: 5563 - RNA, 20 nt, Artificial sequence
  specific aptamers
gguugaggugaggagcggcg

SEQ ID NO: 5564 - RNA, 20 nt, Artificial sequence
  specific aptamers
gguugaggugaggagcggug

SEQ ID NO: 5565 - RNA, 20 nt, Artificial sequence
  specific aptamers
gguugaggugaggaguggag

SEQ ID NO: 5566 - RNA, 20 nt, Artificial sequence
  specific aptamers
gguugaggugaggaguggcg

SEQ ID NO: 5567 - RNA, 20 nt, Artificial sequence
  specific aptamers
gguugaggugaggaguggug

SEQ ID NO: 5568 - RNA, 21 nt, Artificial sequence
  specific aptamers
gguugaggugagguagaggag

SEQ ID NO: 5569 - RNA, 21 nt, Artificial sequence
  specific aptamers
gguugaggugagguagaggcg

SEQ ID NO: 5570 - RNA, 21 nt, Artificial sequence
  specific aptamers
gguugaggugagguagaggug

SEQ ID NO: 5571 - RNA, 21 nt, Artificial sequence
  specific aptamers
gguugaggugagguagcggag

SEQ ID NO: 5572 - RNA, 21 nt, Artificial sequence
  specific aptamers
gguugaggugagguagcggcg

SEQ ID NO: 5573 - RNA, 21 nt, Artificial sequence
  specific aptamers
gguugaggugagguagcggug

SEQ ID NO: 5574 - RNA, 21 nt, Artificial sequence
  specific aptamers
gguugaggugagguaguggag

SEQ ID NO: 5575 - RNA, 21 nt, Artificial sequence
  specific aptamers
gguugaggugagguaguggcg

SEQ ID NO: 5576 - RNA, 21 nt, Artificial sequence
  specific aptamers
gguugaggugagguaguggug

SEQ ID NO: 5577 - RNA, 21 nt, Artificial sequence
  specific aptamers
gguugaggugagguugaggag

SEQ ID NO: 5578 - RNA, 21 nt, Artificial sequence
  specific aptamers
gguugaggugagguugaggcg

SEQ ID NO: 5579 - RNA, 21 nt, Artificial sequence
  specific aptamers
gguugaggugagguugaggug

SEQ ID NO: 5580 - RNA, 21 nt, Artificial sequence
  specific aptamers
gguugaggugagguugcggag

SEQ ID NO: 5581 - RNA, 21 nt, Artificial sequence
  specific aptamers
gguugaggugagguugcggcg

SEQ ID NO: 5582 - RNA, 21 nt, Artificial sequence
  specific aptamers
gguugaggugagguugcggug

SEQ ID NO: 5583 - RNA, 21 nt, Artificial sequence
  specific aptamers
gguugaggugagguuguggag

SEQ ID NO: 5584 - RNA, 21 nt, Artificial sequence
  specific aptamers
gguugaggugagguuguggcg

SEQ ID NO: 5585 - RNA, 21 nt, Artificial sequence
  specific aptamers
gguugaggugagguuguggug

SEQ ID NO: 5586 - RNA, 20 nt, Artificial sequence
  specific aptamers
gguugaggugaggugaggag

SEQ ID NO: 5587 - RNA, 20 nt, Artificial sequence
  specific aptamers
gguugaggugaggugaggcg

SEQ ID NO: 5588 - RNA, 20 nt, Artificial sequence
  specific aptamers
gguugaggugaggugaggug

SEQ ID NO: 5589 - RNA, 20 nt, Artificial sequence
  specific aptamers
gguugaggugaggugcggag

SEQ ID NO: 5590 - RNA, 20 nt, Artificial sequence
  specific aptamers
gguugaggugaggugcggcg

SEQ ID NO: 5591 - RNA, 20 nt, Artificial sequence
  specific aptamers
gguugaggugaggugcggug

SEQ ID NO: 5592 - RNA, 20 nt, Artificial sequence
  specific aptamers
gguugaggugagguguggag

SEQ ID NO: 5593 - RNA, 20 nt, Artificial sequence
  specific aptamers
gguugaggugagguguggcg

SEQ ID NO: 5594 - RNA, 20 nt, Artificial sequence
  specific aptamers
gguugaggugagguguggug

SEQ ID NO: 5595 - RNA, 21 nt, Artificial sequence
  specific aptamers
gguugagguguggaagaggag

SEQ ID NO: 5596 - RNA, 21 nt, Artificial sequence
  specific aptamers
gguugagguguggaagaggcg

SEQ ID NO: 5597 - RNA, 21 nt, Artificial sequence
  specific aptamers
gguugagguguggaagaggug

SEQ ID NO: 5598 - RNA, 21 nt, Artificial sequence
  specific aptamers
gguugagguguggaagcggag

SEQ ID NO: 5599 - RNA, 21 nt, Artificial sequence
  specific aptamers
gguugagguguggaagcggcg

SEQ ID NO: 5600 - RNA, 21 nt, Artificial sequence
  specific aptamers
gguugagguguggaagcggug

SEQ ID NO: 5601 - RNA, 21 nt, Artificial sequence
  specific aptamers
gguugagguguggaaguggag

SEQ ID NO: 5602 - RNA, 21 nt, Artificial sequence
  specific aptamers
gguugagguguggaaguggcg

SEQ ID NO: 5603 - RNA, 21 nt, Artificial sequence
  specific aptamers
gguugagguguggaaguggug

SEQ ID NO: 5604 - RNA, 21 nt, Artificial sequence
  specific aptamers
gguugagguguggaugaggag

SEQ ID NO: 5605 - RNA, 21 nt, Artificial sequence
  specific aptamers
gguugagguguggaugaggcg

SEQ ID NO: 5606 - RNA, 21 nt, Artificial sequence
  specific aptamers
gguugagguguggaugaggug

SEQ ID NO: 5607 - RNA, 21 nt, Artificial sequence
  specific aptamers
gguugagguguggaugcggag

SEQ ID NO: 5608 - RNA, 21 nt, Artificial sequence
  specific aptamers
gguugagguguggaugcggcg

SEQ ID NO: 5609 - RNA, 21 nt, Artificial sequence
  specific aptamers
gguugagguguggaugcggug

SEQ ID NO: 5610 - RNA, 21 nt, Artificial sequence
  specific aptamers
gguugagguguggauguggag

SEQ ID NO: 5611 - RNA, 21 nt, Artificial sequence
  specific aptamers
gguugagguguggauguggcg

SEQ ID NO: 5612 - RNA, 21 nt, Artificial sequence
  specific aptamers
gguugagguguggauguggug

SEQ ID NO: 5613 - RNA, 20 nt, Artificial sequence
  specific aptamers
gguugagguguggagaggag

SEQ ID NO: 5614 - RNA, 20 nt, Artificial sequence
  specific aptamers
gguugagguguggagaggcg

SEQ ID NO: 5615 - RNA, 20 nt, Artificial sequence
  specific aptamers
gguugagguguggagaggug

SEQ ID NO: 5616 - RNA, 20 nt, Artificial sequence
  specific aptamers
gguugagguguggagcggag

SEQ ID NO: 5617 - RNA, 20 nt, Artificial sequence
  specific aptamers
gguugagguguggagcggcg

SEQ ID NO: 5618 - RNA, 20 nt, Artificial sequence
  specific aptamers
gguugagguguggagcggug

SEQ ID NO: 5619 - RNA, 20 nt, Artificial sequence
  specific aptamers
gguugagguguggaguggag

SEQ ID NO: 5620 - RNA, 20 nt, Artificial sequence
  specific aptamers
gguugagguguggaguggcg

SEQ ID NO: 5621 - RNA, 20 nt, Artificial sequence
  specific aptamers
gguugagguguggaguggug

SEQ ID NO: 5622 - RNA, 21 nt, Artificial sequence
  specific aptamers
gguugaggugugguagaggag

SEQ ID NO: 5623 - RNA, 21 nt, Artificial sequence
  specific aptamers
gguugaggugugguagaggcg

SEQ ID NO: 5624 - RNA, 21 nt, Artificial sequence
  specific aptamers
gguugaggugugguagaggug

SEQ ID NO: 5625 - RNA, 21 nt, Artificial sequence
  specific aptamers
gguugaggugugguagcggag

SEQ ID NO: 5626 - RNA, 21 nt, Artificial sequence
  specific aptamers
gguugaggugugguagcggcg

SEQ ID NO: 5627 - RNA, 21 nt, Artificial sequence
  specific aptamers
gguugaggugugguagcggug

SEQ ID NO: 5628 - RNA, 21 nt, Artificial sequence
  specific aptamers
gguugaggugugguaguggag

SEQ ID NO: 5629 - RNA, 21 nt, Artificial sequence
  specific aptamers
gguugaggugugguaguggcg

SEQ ID NO: 5630 - RNA, 21 nt, Artificial sequence
  specific aptamers
gguugaggugugguaguggug

SEQ ID NO: 5631 - RNA, 21 nt, Artificial sequence
  specific aptamers
gguugaggugugguugaggag

SEQ ID NO: 5632 - RNA, 21 nt, Artificial sequence
  specific aptamers
gguugaggugugguugaggcg

SEQ ID NO: 5633 - RNA, 21 nt, Artificial sequence
  specific aptamers
gguugaggugugguugaggug

SEQ ID NO: 5634 - RNA, 21 nt, Artificial sequence
  specific aptamers
gguugaggugugguugcggag

SEQ ID NO: 5635 - RNA, 21 nt, Artificial sequence
  specific aptamers
gguugaggugugguugcggcg

SEQ ID NO: 5636 - RNA, 21 nt, Artificial sequence
  specific aptamers
gguugaggugugguugcggug

SEQ ID NO: 5637 - RNA, 21 nt, Artificial sequence
  specific aptamers
gguugaggugugguuguggag

SEQ ID NO: 5638 - RNA, 21 nt, Artificial sequence
  specific aptamers
gguugaggugugguuguggcg

SEQ ID NO: 5639 - RNA, 21 nt, Artificial sequence
  specific aptamers
gguugaggugugguuguggug

SEQ ID NO: 5640 - RNA, 20 nt, Artificial sequence
  specific aptamers
gguugagguguggugaggag

SEQ ID NO: 5641 - RNA, 20 nt, Artificial sequence
  specific aptamers
gguugagguguggugaggcg

SEQ ID NO: 5642 - RNA, 20 nt, Artificial sequence
  specific aptamers
gguugagguguggugaggug

SEQ ID NO: 5643 - RNA, 20 nt, Artificial sequence
  specific aptamers
gguugagguguggugcggag

SEQ ID NO: 5644 - RNA, 20 nt, Artificial sequence
  specific aptamers
gguugagguguggugcggcg

SEQ ID NO: 5645 - RNA, 20 nt, Artificial sequence
  specific aptamers
gguugagguguggugcggug

SEQ ID NO: 5646 - RNA, 20 nt, Artificial sequence
  specific aptamers
gguugaggugugguguggag

SEQ ID NO: 5647 - RNA, 20 nt, Artificial sequence
  specific aptamers
gguugaggugugguguggcg

SEQ ID NO: 5648 - RNA, 20 nt, Artificial sequence
  specific aptamers
gguugaggugugguguggug

SEQ ID NO: 5649 - RNA, 21 nt, Artificial sequence
  specific aptamers
gguuguggagaggaagaggag

SEQ ID NO: 5650 - RNA, 21 nt, Artificial sequence
  specific aptamers
gguuguggagaggaagaggcg

SEQ ID NO: 5651 - RNA, 21 nt, Artificial sequence
  specific aptamers
gguuguggagaggaagaggug

SEQ ID NO: 5652 - RNA, 21 nt, Artificial sequence
  specific aptamers
gguuguggagaggaagcggag

SEQ ID NO: 5653 - RNA, 21 nt, Artificial sequence
  specific aptamers
gguuguggagaggaagcggcg

SEQ ID NO: 5654 - RNA, 21 nt, Artificial sequence
  specific aptamers
gguuguggagaggaagcggug

SEQ ID NO: 5655 - RNA, 21 nt, Artificial sequence
  specific aptamers
gguuguggagaggaaguggag

SEQ ID NO: 5656 - RNA, 21 nt, Artificial sequence
  specific aptamers
gguuguggagaggaaguggcg

SEQ ID NO: 5657 - RNA, 21 nt, Artificial sequence
  specific aptamers
gguuguggagaggaaguggug

SEQ ID NO: 5658 - RNA, 21 nt, Artificial sequence
  specific aptamers
gguuguggagaggaugaggag

SEQ ID NO: 5659 - RNA, 21 nt, Artificial sequence
  specific aptamers
gguuguggagaggaugaggcg

SEQ ID NO: 5660 - RNA, 21 nt, Artificial sequence
  specific aptamers
gguuguggagaggaugaggug

SEQ ID NO: 5661 - RNA, 21 nt, Artificial sequence
  specific aptamers
gguuguggagaggaugcggag

SEQ ID NO: 5662 - RNA, 21 nt, Artificial sequence
  specific aptamers
gguuguggagaggaugcggcg

SEQ ID NO: 5663 - RNA, 21 nt, Artificial sequence
  specific aptamers
gguuguggagaggaugcggug

SEQ ID NO: 5664 - RNA, 21 nt, Artificial sequence
  specific aptamers
gguuguggagaggauguggag

SEQ ID NO: 5665 - RNA, 21 nt, Artificial sequence
  specific aptamers
gguuguggagaggauguggcg

SEQ ID NO: 5666 - RNA, 21 nt, Artificial sequence
  specific aptamers
gguuguggagaggauguggug

SEQ ID NO: 5667 - RNA, 20 nt, Artificial sequence
  specific aptamers
gguuguggagaggagaggag

SEQ ID NO: 5668 - RNA, 20 nt, Artificial sequence
  specific aptamers
gguuguggagaggagaggcg

SEQ ID NO: 5669 - RNA, 20 nt, Artificial sequence
  specific aptamers
gguuguggagaggagaggug

SEQ ID NO: 5670 - RNA, 20 nt, Artificial sequence
  specific aptamers
gguuguggagaggagcggag

SEQ ID NO: 5671 - RNA, 20 nt, Artificial sequence
  specific aptamers
gguuguggagaggagcggcg

SEQ ID NO: 5672 - RNA, 20 nt, Artificial sequence
  specific aptamers
gguuguggagaggagcggug

SEQ ID NO: 5673 - RNA, 20 nt, Artificial sequence
  specific aptamers
gguuguggagaggaguggag

SEQ ID NO: 5674 - RNA, 20 nt, Artificial sequence
  specific aptamers
gguuguggagaggaguggcg

SEQ ID NO: 5675 - RNA, 20 nt, Artificial sequence
  specific aptamers
gguuguggagaggaguggug

SEQ ID NO: 5676 - RNA, 21 nt, Artificial sequence
  specific aptamers
gguuguggagagguagaggag

SEQ ID NO: 5677 - RNA, 21 nt, Artificial sequence
  specific aptamers
gguuguggagagguagaggcg

SEQ ID NO: 5678 - RNA, 21 nt, Artificial sequence
  specific aptamers
gguuguggagagguagaggug

SEQ ID NO: 5679 - RNA, 21 nt, Artificial sequence
  specific aptamers
gguuguggagagguagcggag

SEQ ID NO: 5680 - RNA, 21 nt, Artificial sequence
  specific aptamers
gguuguggagagguagcggcg

SEQ ID NO: 5681 - RNA, 21 nt, Artificial sequence
  specific aptamers
gguuguggagagguagcggug

SEQ ID NO: 5682 - RNA, 21 nt, Artificial sequence
  specific aptamers
gguuguggagagguaguggag

SEQ ID NO: 5683 - RNA, 21 nt, Artificial sequence
  specific aptamers
gguuguggagagguaguggcg

SEQ ID NO: 5684 - RNA, 21 nt, Artificial sequence
  specific aptamers
gguuguggagagguaguggug

SEQ ID NO: 5685 - RNA, 21 nt, Artificial sequence
  specific aptamers
gguuguggagagguugaggag

SEQ ID NO: 5686 - RNA, 21 nt, Artificial sequence
  specific aptamers
gguuguggagagguugaggcg

SEQ ID NO: 5687 - RNA, 21 nt, Artificial sequence
  specific aptamers
gguuguggagagguugaggug

SEQ ID NO: 5688 - RNA, 21 nt, Artificial sequence
  specific aptamers
gguuguggagagguugcggag

SEQ ID NO: 5689 - RNA, 21 nt, Artificial sequence
  specific aptamers
gguuguggagagguugcggcg

SEQ ID NO: 5690 - RNA, 21 nt, Artificial sequence
  specific aptamers
gguuguggagagguugcggug

SEQ ID NO: 5691 - RNA, 21 nt, Artificial sequence
  specific aptamers
gguuguggagagguuguggag

SEQ ID NO: 5692 - RNA, 21 nt, Artificial sequence
  specific aptamers
gguuguggagagguuguggcg

SEQ ID NO: 5693 - RNA, 21 nt, Artificial sequence
  specific aptamers
gguuguggagagguuguggug

SEQ ID NO: 5694 - RNA, 20 nt, Artificial sequence
  specific aptamers
gguuguggagaggugaggag

SEQ ID NO: 5695 - RNA, 20 nt, Artificial sequence
  specific aptamers
gguuguggagaggugaggcg

SEQ ID NO: 5696 - RNA, 20 nt, Artificial sequence
  specific aptamers
gguuguggagaggugaggug

SEQ ID NO: 5697 - RNA, 20 nt, Artificial sequence
  specific aptamers
gguuguggagaggugcggag

SEQ ID NO: 5698 - RNA, 20 nt, Artificial sequence
  specific aptamers
gguuguggagaggugcggcg

SEQ ID NO: 5699 - RNA, 20 nt, Artificial sequence
  specific aptamers
gguuguggagaggugcggug

SEQ ID NO: 5700 - RNA, 20 nt, Artificial sequence
  specific aptamers
gguuguggagagguguggag

SEQ ID NO: 5701 - RNA, 20 nt, Artificial sequence
  specific aptamers
gguuguggagagguguggcg

SEQ ID NO: 5702 - RNA, 20 nt, Artificial sequence
  specific aptamers
gguuguggagagguguggug

SEQ ID NO: 5703 - RNA, 21 nt, Artificial sequence
  specific aptamers
gguuguggaguggaagaggag

SEQ ID NO: 5704 - RNA, 21 nt, Artificial sequence
  specific aptamers
gguuguggaguggaagaggcg

SEQ ID NO: 5705 - RNA, 21 nt, Artificial sequence
  specific aptamers
gguuguggaguggaagaggug

SEQ ID NO: 5706 - RNA, 21 nt, Artificial sequence
  specific aptamers
gguuguggaguggaagcggag

SEQ ID NO: 5707 - RNA, 21 nt, Artificial sequence
  specific aptamers
gguuguggaguggaagcggcg

SEQ ID NO: 5708 - RNA, 21 nt, Artificial sequence
  specific aptamers
gguuguggaguggaagcggug

SEQ ID NO: 5709 - RNA, 21 nt, Artificial sequence
  specific aptamers
gguuguggaguggaaguggag

SEQ ID NO: 5710 - RNA, 21 nt, Artificial sequence
  specific aptamers
gguuguggaguggaaguggcg

SEQ ID NO: 5711 - RNA, 21 nt, Artificial sequence
  specific aptamers
gguuguggaguggaaguggug

SEQ ID NO: 5712 - RNA, 21 nt, Artificial sequence
  specific aptamers
gguuguggaguggaugaggag

SEQ ID NO: 5713 - RNA, 21 nt, Artificial sequence
  specific aptamers
gguuguggaguggaugaggcg

SEQ ID NO: 5714 - RNA, 21 nt, Artificial sequence
  specific aptamers
gguuguggaguggaugaggug

SEQ ID NO: 5715 - RNA, 21 nt, Artificial sequence
  specific aptamers
gguuguggaguggaugcggag

SEQ ID NO: 5716 - RNA, 21 nt, Artificial sequence
  specific aptamers
gguuguggaguggaugcggcg

SEQ ID NO: 5717 - RNA, 21 nt, Artificial sequence
  specific aptamers
gguuguggaguggaugcggug

SEQ ID NO: 5718 - RNA, 21 nt, Artificial sequence
  specific aptamers
gguuguggaguggauguggag

SEQ ID NO: 5719 - RNA, 21 nt, Artificial sequence
  specific aptamers
gguuguggaguggauguggcg

SEQ ID NO: 5720 - RNA, 21 nt, Artificial sequence
  specific aptamers
gguuguggaguggauguggug

SEQ ID NO: 5721 - RNA, 20 nt, Artificial sequence
  specific aptamers
gguuguggaguggagaggag

SEQ ID NO: 5722 - RNA, 20 nt, Artificial sequence
  specific aptamers
gguuguggaguggagaggcg

SEQ ID NO: 5723 - RNA, 20 nt, Artificial sequence
  specific aptamers
gguuguggaguggagaggug

SEQ ID NO: 5724 - RNA, 20 nt, Artificial sequence
  specific aptamers
gguuguggaguggagcggag

SEQ ID NO: 5725 - RNA, 20 nt, Artificial sequence
  specific aptamers
gguuguggaguggagcggcg

SEQ ID NO: 5726 - RNA, 20 nt, Artificial sequence
  specific aptamers
gguuguggaguggagcggug

SEQ ID NO: 5727 - RNA, 20 nt, Artificial sequence
  specific aptamers
gguuguggaguggaguggag

SEQ ID NO: 5728 - RNA, 20 nt, Artificial sequence
  specific aptamers
gguuguggaguggaguggcg

SEQ ID NO: 5729 - RNA, 20 nt, Artificial sequence
  specific aptamers
gguuguggaguggaguggug

SEQ ID NO: 5730 - RNA, 21 nt, Artificial sequence
  specific aptamers
gguuguggagugguagaggag

SEQ ID NO: 5731 - RNA, 21 nt, Artificial sequence
  specific aptamers
gguuguggagugguagaggcg

SEQ ID NO: 5732 - RNA, 21 nt, Artificial sequence
  specific aptamers
gguuguggagugguagaggug

SEQ ID NO: 5733 - RNA, 21 nt, Artificial sequence
  specific aptamers
gguuguggagugguagcggag

SEQ ID NO: 5734 - RNA, 21 nt, Artificial sequence
  specific aptamers
gguuguggagugguagcggcg

SEQ ID NO: 5735 - RNA, 21 nt, Artificial sequence
  specific aptamers
gguuguggagugguagcggug

SEQ ID NO: 5736 - RNA, 21 nt, Artificial sequence
  specific aptamers
gguuguggagugguaguggag

SEQ ID NO: 5737 - RNA, 21 nt, Artificial sequence
  specific aptamers
gguuguggagugguaguggcg

SEQ ID NO: 5738 - RNA, 21 nt, Artificial sequence
  specific aptamers
gguuguggagugguaguggug

SEQ ID NO: 5739 - RNA, 21 nt, Artificial sequence
  specific aptamers
gguuguggagugguugaggag

SEQ ID NO: 5740 - RNA, 21 nt, Artificial sequence
  specific aptamers
gguuguggagugguugaggcg

SEQ ID NO: 5741 - RNA, 21 nt, Artificial sequence
  specific aptamers
gguuguggagugguugaggug

SEQ ID NO: 5742 - RNA, 21 nt, Artificial sequence
  specific aptamers
gguuguggagugguugcggag

SEQ ID NO: 5743 - RNA, 21 nt, Artificial sequence
  specific aptamers
gguuguggagugguugcggcg

SEQ ID NO: 5744 - RNA, 21 nt, Artificial sequence
  specific aptamers
gguuguggagugguugcggug

SEQ ID NO: 5745 - RNA, 21 nt, Artificial sequence
  specific aptamers
gguuguggagugguuguggag

SEQ ID NO: 5746 - RNA, 21 nt, Artificial sequence
  specific aptamers
gguuguggagugguuguggcg

SEQ ID NO: 5747 - RNA, 21 nt, Artificial sequence
  specific aptamers
gguuguggagugguuguggug

SEQ ID NO: 5748 - RNA, 20 nt, Artificial sequence
  specific aptamers
gguuguggaguggugaggag

SEQ ID NO: 5749 - RNA, 20 nt, Artificial sequence
  specific aptamers
gguuguggaguggugaggcg

SEQ ID NO: 5750 - RNA, 20 nt, Artificial sequence
  specific aptamers
gguuguggaguggugaggug

SEQ ID NO: 5751 - RNA, 20 nt, Artificial sequence
  specific aptamers
gguuguggaguggugcggag

SEQ ID NO: 5752 - RNA, 20 nt, Artificial sequence
  specific aptamers
gguuguggaguggugcggcg

SEQ ID NO: 5753 - RNA, 20 nt, Artificial sequence
  specific aptamers
gguuguggaguggugcggug

SEQ ID NO: 5754 - RNA, 20 nt, Artificial sequence
  specific aptamers
gguuguggagugguguggag

SEQ ID NO: 5755 - RNA, 20 nt, Artificial sequence
  specific aptamers
gguuguggagugguguggcg

SEQ ID NO: 5756 - RNA, 20 nt, Artificial sequence
  specific aptamers
gguuguggagugguguggug

SEQ ID NO: 5757 - RNA, 21 nt, Artificial sequence
  specific aptamers
gguuguggugaggaagaggag

SEQ ID NO: 5758 - RNA, 21 nt, Artificial sequence
  specific aptamers
gguuguggugaggaagaggcg

SEQ ID NO: 5759 - RNA, 21 nt, Artificial sequence
  specific aptamers
gguuguggugaggaagaggug

SEQ ID NO: 5760 - RNA, 21 nt, Artificial sequence
  specific aptamers
gguuguggugaggaagcggag

SEQ ID NO: 5761 - RNA, 21 nt, Artificial sequence
  specific aptamers
gguuguggugaggaagcggcg

SEQ ID NO: 5762 - RNA, 21 nt, Artificial sequence
  specific aptamers
gguuguggugaggaagcggug

SEQ ID NO: 5763 - RNA, 21 nt, Artificial sequence
  specific aptamers
gguuguggugaggaaguggag

SEQ ID NO: 5764 - RNA, 21 nt, Artificial sequence
  specific aptamers
gguuguggugaggaaguggcg

SEQ ID NO: 5765 - RNA, 21 nt, Artificial sequence
  specific aptamers
gguuguggugaggaaguggug

SEQ ID NO: 5766 - RNA, 21 nt, Artificial sequence
  specific aptamers
gguuguggugaggaugaggag

SEQ ID NO: 5767 - RNA, 21 nt, Artificial sequence
  specific aptamers
gguuguggugaggaugaggcg

SEQ ID NO: 5768 - RNA, 21 nt, Artificial sequence
  specific aptamers
gguuguggugaggaugaggug

SEQ ID NO: 5769 - RNA, 21 nt, Artificial sequence
  specific aptamers
gguuguggugaggaugcggag

SEQ ID NO: 5770 - RNA, 21 nt, Artificial sequence
  specific aptamers
gguuguggugaggaugcggcg

SEQ ID NO: 5771 - RNA, 21 nt, Artificial sequence
  specific aptamers
gguuguggugaggaugcggug

SEQ ID NO: 5772 - RNA, 21 nt, Artificial sequence
  specific aptamers
gguuguggugaggauguggag

SEQ ID NO: 5773 - RNA, 21 nt, Artificial sequence
  specific aptamers
gguuguggugaggauguggcg

SEQ ID NO: 5774 - RNA, 21 nt, Artificial sequence
  specific aptamers
gguuguggugaggauguggug

SEQ ID NO: 5775 - RNA, 20 nt, Artificial sequence
  specific aptamers
gguuguggugaggagaggag

SEQ ID NO: 5776 - RNA, 20 nt, Artificial sequence
  specific aptamers
gguuguggugaggagaggcg

SEQ ID NO: 5777 - RNA, 20 nt, Artificial sequence
  specific aptamers
gguuguggugaggagaggug

SEQ ID NO: 5778 - RNA, 20 nt, Artificial sequence
  specific aptamers
gguuguggugaggagcggag

SEQ ID NO: 5779 - RNA, 20 nt, Artificial sequence
  specific aptamers
gguuguggugaggagcggcg

SEQ ID NO: 5780 - RNA, 20 nt, Artificial sequence
  specific aptamers
gguuguggugaggagcggug

SEQ ID NO: 5781 - RNA, 20 nt, Artificial sequence
  specific aptamers
gguuguggugaggaguggag

SEQ ID NO: 5782 - RNA, 20 nt, Artificial sequence
  specific aptamers
gguuguggugaggaguggcg

SEQ ID NO: 5783 - RNA, 20 nt, Artificial sequence
  specific aptamers
gguuguggugaggaguggug

SEQ ID NO: 5784 - RNA, 21 nt, Artificial sequence
  specific aptamers
gguuguggugagguagaggag

SEQ ID NO: 5785 - RNA, 21 nt, Artificial sequence
  specific aptamers
gguuguggugagguagaggcg

SEQ ID NO: 5786 - RNA, 21 nt, Artificial sequence
  specific aptamers
gguuguggugagguagaggug

SEQ ID NO: 5787 - RNA, 21 nt, Artificial sequence
  specific aptamers
gguuguggugagguagcggag

SEQ ID NO: 5788 - RNA, 21 nt, Artificial sequence
  specific aptamers
gguuguggugagguagcggcg

SEQ ID NO: 5789 - RNA, 21 nt, Artificial sequence
  specific aptamers
gguuguggugagguagcggug

SEQ ID NO: 5790 - RNA, 21 nt, Artificial sequence
  specific aptamers
gguuguggugagguaguggag

SEQ ID NO: 5791 - RNA, 21 nt, Artificial sequence
  specific aptamers
gguuguggugagguaguggcg

SEQ ID NO: 5792 - RNA, 21 nt, Artificial sequence
  specific aptamers
gguuguggugagguaguggug

SEQ ID NO: 5793 - RNA, 21 nt, Artificial sequence
  specific aptamers
gguuguggugagguugaggag

SEQ ID NO: 5794 - RNA, 21 nt, Artificial sequence
  specific aptamers
gguuguggugagguugaggcg

SEQ ID NO: 5795 - RNA, 21 nt, Artificial sequence
  specific aptamers
gguuguggugagguugaggug

SEQ ID NO: 5796 - RNA, 21 nt, Artificial sequence
  specific aptamers
gguuguggugagguugcggag

SEQ ID NO: 5797 - RNA, 21 nt, Artificial sequence
  specific aptamers
gguuguggugagguugcggcg

SEQ ID NO: 5798 - RNA, 21 nt, Artificial sequence
  specific aptamers
gguuguggugagguugcggug

SEQ ID NO: 5799 - RNA, 21 nt, Artificial sequence
  specific aptamers
gguuguggugagguuguggag

SEQ ID NO: 5800 - RNA, 21 nt, Artificial sequence
  specific aptamers
gguuguggugagguuguggcg

SEQ ID NO: 5801 - RNA, 21 nt, Artificial sequence
  specific aptamers
gguuguggugagguuguggug

SEQ ID NO: 5802 - RNA, 20 nt, Artificial sequence
  specific aptamers
gguuguggugaggugaggag

SEQ ID NO: 5803 - RNA, 20 nt, Artificial sequence
  specific aptamers
gguuguggugaggugaggcg

SEQ ID NO: 5804 - RNA, 20 nt, Artificial sequence
  specific aptamers
gguuguggugaggugaggug

SEQ ID NO: 5805 - RNA, 20 nt, Artificial sequence
  specific aptamers
gguuguggugaggugcggag

SEQ ID NO: 5806 - RNA, 20 nt, Artificial sequence
  specific aptamers
gguuguggugaggugcggcg

SEQ ID NO: 5807 - RNA, 20 nt, Artificial sequence
  specific aptamers
gguuguggugaggugcggug

SEQ ID NO: 5808 - RNA, 20 nt, Artificial sequence
  specific aptamers
gguuguggugagguguggag

SEQ ID NO: 5809 - RNA, 20 nt, Artificial sequence
  specific aptamers
gguuguggugagguguggcg

SEQ ID NO: 5810 - RNA, 20 nt, Artificial sequence
  specific aptamers
gguuguggugagguguggug

SEQ ID NO: 5811 - RNA, 21 nt, Artificial sequence
  specific aptamers
gguugugguguggaagaggag

SEQ ID NO: 5812 - RNA, 21 nt, Artificial sequence
  specific aptamers
gguugugguguggaagaggcg

SEQ ID NO: 5813 - RNA, 21 nt, Artificial sequence
  specific aptamers
gguugugguguggaagaggug

SEQ ID NO: 5814 - RNA, 21 nt, Artificial sequence
  specific aptamers
gguugugguguggaagcggag

SEQ ID NO: 5815 - RNA, 21 nt, Artificial sequence
  specific aptamers
gguugugguguggaagcggcg

SEQ ID NO: 5816 - RNA, 21 nt, Artificial sequence
  specific aptamers
gguugugguguggaagcggug

SEQ ID NO: 5817 - RNA, 21 nt, Artificial sequence
  specific aptamers
gguugugguguggaaguggag

SEQ ID NO: 5818 - RNA, 21 nt, Artificial sequence
  specific aptamers
gguugugguguggaaguggcg

SEQ ID NO: 5819 - RNA, 21 nt, Artificial sequence
  specific aptamers
gguugugguguggaaguggug

SEQ ID NO: 5820 - RNA, 21 nt, Artificial sequence
  specific aptamers
gguugugguguggaugaggag

SEQ ID NO: 5821 - RNA, 21 nt, Artificial sequence
  specific aptamers
gguugugguguggaugaggcg

SEQ ID NO: 5822 - RNA, 21 nt, Artificial sequence
  specific aptamers
gguugugguguggaugaggug

SEQ ID NO: 5823 - RNA, 21 nt, Artificial sequence
  specific aptamers
gguugugguguggaugcggag

SEQ ID NO: 5824 - RNA, 21 nt, Artificial sequence
  specific aptamers
gguugugguguggaugcggcg

SEQ ID NO: 5825 - RNA, 21 nt, Artificial sequence
  specific aptamers
gguugugguguggaugcggug

SEQ ID NO: 5826 - RNA, 21 nt, Artificial sequence
  specific aptamers
gguugugguguggauguggag

SEQ ID NO: 5827 - RNA, 21 nt, Artificial sequence
  specific aptamers
gguugugguguggauguggcg

SEQ ID NO: 5828 - RNA, 21 nt, Artificial sequence
  specific aptamers
gguugugguguggauguggug

SEQ ID NO: 5829 - RNA, 20 nt, Artificial sequence
  specific aptamers
gguugugguguggagaggag

SEQ ID NO: 5830 - RNA, 20 nt, Artificial sequence
  specific aptamers
gguugugguguggagaggcg

SEQ ID NO: 5831 - RNA, 20 nt, Artificial sequence
  specific aptamers
gguugugguguggagaggug

SEQ ID NO: 5832 - RNA, 20 nt, Artificial sequence
  specific aptamers
gguugugguguggagcggag

SEQ ID NO: 5833 - RNA, 20 nt, Artificial sequence
  specific aptamers
gguugugguguggagcggcg

SEQ ID NO: 5834 - RNA, 20 nt, Artificial sequence
  specific aptamers
gguugugguguggagcggug

SEQ ID NO: 5835 - RNA, 20 nt, Artificial sequence
  specific aptamers
gguugugguguggaguggag

SEQ ID NO: 5836 - RNA, 20 nt, Artificial sequence
  specific aptamers
gguugugguguggaguggcg

SEQ ID NO: 5837 - RNA, 20 nt, Artificial sequence
  specific aptamers
gguugugguguggaguggug

SEQ ID NO: 5838 - RNA, 21 nt, Artificial sequence
  specific aptamers
gguuguggugugguagaggag

SEQ ID NO: 5839 - RNA, 21 nt, Artificial sequence
  specific aptamers
gguuguggugugguagaggcg

SEQ ID NO: 5840 - RNA, 21 nt, Artificial sequence
  specific aptamers
gguuguggugugguagaggug

SEQ ID NO: 5841 - RNA, 21 nt, Artificial sequence
  specific aptamers
gguuguggugugguagcggag

SEQ ID NO: 5842 - RNA, 21 nt, Artificial sequence
  specific aptamers
gguuguggugugguagcggcg

SEQ ID NO: 5843 - RNA, 21 nt, Artificial sequence
  specific aptamers
gguuguggugugguagcggug

SEQ ID NO: 5844 - RNA, 21 nt, Artificial sequence
  specific aptamers
gguuguggugugguaguggag

SEQ ID NO: 5845 - RNA, 21 nt, Artificial sequence
  specific aptamers
gguuguggugugguaguggcg

SEQ ID NO: 5846 - RNA, 21 nt, Artificial sequence
  specific aptamers
gguuguggugugguaguggug

SEQ ID NO: 5847 - RNA, 21 nt, Artificial sequence
  specific aptamers
gguuguggugugguugaggag

SEQ ID NO: 5848 - RNA, 21 nt, Artificial sequence
  specific aptamers
gguuguggugugguugaggcg

SEQ ID NO: 5849 - RNA, 21 nt, Artificial sequence
  specific aptamers
gguuguggugugguugaggug

SEQ ID NO: 5850 - RNA, 21 nt, Artificial sequence
  specific aptamers
gguuguggugugguugcggag

SEQ ID NO: 5851 - RNA, 21 nt, Artificial sequence
  specific aptamers
gguuguggugugguugcggcg

SEQ ID NO: 5852 - RNA, 21 nt, Artificial sequence
  specific aptamers
gguuguggugugguugcggug

SEQ ID NO: 5853 - RNA, 21 nt, Artificial sequence
  specific aptamers
gguuguggugugguuguggag

SEQ ID NO: 5854 - RNA, 21 nt, Artificial sequence
  specific aptamers
gguuguggugugguuguggcg

SEQ ID NO: 5855 - RNA, 21 nt, Artificial sequence
  specific aptamers
gguuguggugugguuguggug

SEQ ID NO: 5856 - RNA, 20 nt, Artificial sequence
  specific aptamers
gguugugguguggugaggag

SEQ ID NO: 5857 - RNA, 20 nt, Artificial sequence
  specific aptamers
gguugugguguggugaggcg

SEQ ID NO: 5858 - RNA, 20 nt, Artificial sequence
  specific aptamers
gguugugguguggugaggug

SEQ ID NO: 5859 - RNA, 20 nt, Artificial sequence
  specific aptamers
gguugugguguggugcggag

SEQ ID NO: 5860 - RNA, 20 nt, Artificial sequence
  specific aptamers
gguugugguguggugcggcg

SEQ ID NO: 5861 - RNA, 20 nt, Artificial sequence
  specific aptamers
gguugugguguggugcggug

SEQ ID NO: 5862 - RNA, 20 nt, Artificial sequence
  specific aptamers
gguuguggugugguguggag

SEQ ID NO: 5863 - RNA, 20 nt, Artificial sequence
  specific aptamers
gguuguggugugguguggcg

SEQ ID NO: 5864 - RNA, 20 nt, Artificial sequence
  specific aptamers
gguuguggugugguguggug

SEQ ID NO: 5865 - RNA, 20 nt, Artificial sequence
  specific aptamers
ggagaggagaggaagaggag

SEQ ID NO: 5866 - RNA, 20 nt, Artificial sequence
  specific aptamers
ggagaggagaggaagaggcg

SEQ ID NO: 5867 - RNA, 20 nt, Artificial sequence
  specific aptamers
ggagaggagaggaagaggug

SEQ ID NO: 5868 - RNA, 20 nt, Artificial sequence
  specific aptamers
ggagaggagaggaagcggag

SEQ ID NO: 5869 - RNA, 20 nt, Artificial sequence
  specific aptamers
ggagaggagaggaagcggcg

SEQ ID NO: 5870 - RNA, 20 nt, Artificial sequence
  specific aptamers
ggagaggagaggaagcggug

SEQ ID NO: 5871 - RNA, 20 nt, Artificial sequence
  specific aptamers
ggagaggagaggaaguggag

SEQ ID NO: 5872 - RNA, 20 nt, Artificial sequence
  specific aptamers
ggagaggagaggaaguggcg

SEQ ID NO: 5873 - RNA, 20 nt, Artificial sequence
  specific aptamers
ggagaggagaggaaguggug

SEQ ID NO: 5874 - RNA, 20 nt, Artificial sequence
  specific aptamers
ggagaggagaggaugaggag

SEQ ID NO: 5875 - RNA, 20 nt, Artificial sequence
  specific aptamers
ggagaggagaggaugaggcg

SEQ ID NO: 5876 - RNA, 20 nt, Artificial sequence
  specific aptamers
ggagaggagaggaugaggug

SEQ ID NO: 5877 - RNA, 20 nt, Artificial sequence
  specific aptamers
ggagaggagaggaugcggag

SEQ ID NO: 5878 - RNA, 20 nt, Artificial sequence
  specific aptamers
ggagaggagaggaugcggcg

SEQ ID NO: 5879 - RNA, 20 nt, Artificial sequence
  specific aptamers
ggagaggagaggaugcggug

SEQ ID NO: 5880 - RNA, 20 nt, Artificial sequence
  specific aptamers
ggagaggagaggauguggag

SEQ ID NO: 5881 - RNA, 20 nt, Artificial sequence
  specific aptamers
ggagaggagaggauguggcg

SEQ ID NO: 5882 - RNA, 20 nt, Artificial sequence
  specific aptamers
ggagaggagaggauguggug

SEQ ID NO: 5883 - RNA, 19 nt, Artificial sequence
  specific aptamers
ggagaggagaggagaggag

SEQ ID NO: 5884 - RNA, 19 nt, Artificial sequence
  specific aptamers
ggagaggagaggagaggcg

SEQ ID NO: 5885 - RNA, 19 nt, Artificial sequence
  specific aptamers
ggagaggagaggagaggug

SEQ ID NO: 5886 - RNA, 19 nt, Artificial sequence
  specific aptamers
ggagaggagaggagcggag

SEQ ID NO: 5887 - RNA, 19 nt, Artificial sequence
  specific aptamers
ggagaggagaggagcggcg

SEQ ID NO: 5888 - RNA, 19 nt, Artificial sequence
  specific aptamers
ggagaggagaggagcggug

SEQ ID NO: 5889 - RNA, 19 nt, Artificial sequence
  specific aptamers
ggagaggagaggaguggag

SEQ ID NO: 5890 - RNA, 19 nt, Artificial sequence
  specific aptamers
ggagaggagaggaguggcg

SEQ ID NO: 5891 - RNA, 19 nt, Artificial sequence
  specific aptamers
ggagaggagaggaguggug

SEQ ID NO: 5892 - RNA, 20 nt, Artificial sequence
  specific aptamers
ggagaggagagguagaggag

SEQ ID NO: 5893 - RNA, 20 nt, Artificial sequence
  specific aptamers
ggagaggagagguagaggcg

SEQ ID NO: 5894 - RNA, 20 nt, Artificial sequence
  specific aptamers
ggagaggagagguagaggug

SEQ ID NO: 5895 - RNA, 20 nt, Artificial sequence
  specific aptamers
ggagaggagagguagcggag

SEQ ID NO: 5896 - RNA, 20 nt, Artificial sequence
  specific aptamers
ggagaggagagguagcggcg

SEQ ID NO: 5897 - RNA, 20 nt, Artificial sequence
  specific aptamers
ggagaggagagguagcggug

SEQ ID NO: 5898 - RNA, 20 nt, Artificial sequence
  specific aptamers
ggagaggagagguaguggag

SEQ ID NO: 5899 - RNA, 20 nt, Artificial sequence
  specific aptamers
ggagaggagagguaguggcg

SEQ ID NO: 5900 - RNA, 20 nt, Artificial sequence
  specific aptamers
ggagaggagagguaguggug

SEQ ID NO: 5901 - RNA, 20 nt, Artificial sequence
  specific aptamers
ggagaggagagguugaggag

SEQ ID NO: 5902 - RNA, 20 nt, Artificial sequence
  specific aptamers
ggagaggagagguugaggcg

SEQ ID NO: 5903 - RNA, 20 nt, Artificial sequence
  specific aptamers
ggagaggagagguugaggug

SEQ ID NO: 5904 - RNA, 20 nt, Artificial sequence
  specific aptamers
ggagaggagagguugcggag

SEQ ID NO: 5905 - RNA, 20 nt, Artificial sequence
  specific aptamers
ggagaggagagguugcggcg

SEQ ID NO: 5906 - RNA, 20 nt, Artificial sequence
  specific aptamers
ggagaggagagguugcggug

SEQ ID NO: 5907 - RNA, 20 nt, Artificial sequence
  specific aptamers
ggagaggagagguuguggag

SEQ ID NO: 5908 - RNA, 20 nt, Artificial sequence
  specific aptamers
ggagaggagagguuguggcg

SEQ ID NO: 5909 - RNA, 20 nt, Artificial sequence
  specific aptamers
ggagaggagagguuguggug

SEQ ID NO: 5910 - RNA, 19 nt, Artificial sequence
  specific aptamers
ggagaggagaggugaggag

SEQ ID NO: 5911 - RNA, 19 nt, Artificial sequence
  specific aptamers
ggagaggagaggugaggcg

SEQ ID NO: 5912 - RNA, 19 nt, Artificial sequence
  specific aptamers
ggagaggagaggugaggug

SEQ ID NO: 5913 - RNA, 19 nt, Artificial sequence
  specific aptamers
ggagaggagaggugcggag

SEQ ID NO: 5914 - RNA, 19 nt, Artificial sequence
  specific aptamers
ggagaggagaggugcggcg

SEQ ID NO: 5915 - RNA, 19 nt, Artificial sequence
  specific aptamers
ggagaggagaggugcggug

SEQ ID NO: 5916 - RNA, 19 nt, Artificial sequence
  specific aptamers
ggagaggagagguguggag

SEQ ID NO: 5917 - RNA, 19 nt, Artificial sequence
  specific aptamers
ggagaggagagguguggcg

SEQ ID NO: 5918 - RNA, 19 nt, Artificial sequence
  specific aptamers
ggagaggagagguguggug

SEQ ID NO: 5919 - RNA, 20 nt, Artificial sequence
  specific aptamers
ggagaggaguggaagaggag

SEQ ID NO: 5920 - RNA, 20 nt, Artificial sequence
  specific aptamers
ggagaggaguggaagaggcg

SEQ ID NO: 5921 - RNA, 20 nt, Artificial sequence
  specific aptamers
ggagaggaguggaagaggug

SEQ ID NO: 5922 - RNA, 20 nt, Artificial sequence
  specific aptamers
ggagaggaguggaagcggag

SEQ ID NO: 5923 - RNA, 20 nt, Artificial sequence
  specific aptamers
ggagaggaguggaagcggcg

SEQ ID NO: 5924 - RNA, 20 nt, Artificial sequence
  specific aptamers
ggagaggaguggaagcggug

SEQ ID NO: 5925 - RNA, 20 nt, Artificial sequence
  specific aptamers
ggagaggaguggaaguggag

SEQ ID NO: 5926 - RNA, 20 nt, Artificial sequence
  specific aptamers
ggagaggaguggaaguggcg

SEQ ID NO: 5927 - RNA, 20 nt, Artificial sequence
  specific aptamers
ggagaggaguggaaguggug

SEQ ID NO: 5928 - RNA, 20 nt, Artificial sequence
  specific aptamers
ggagaggaguggaugaggag

SEQ ID NO: 5929 - RNA, 20 nt, Artificial sequence
  specific aptamers
ggagaggaguggaugaggcg

SEQ ID NO: 5930 - RNA, 20 nt, Artificial sequence
  specific aptamers
ggagaggaguggaugaggug

SEQ ID NO: 5931 - RNA, 20 nt, Artificial sequence
  specific aptamers
ggagaggaguggaugcggag

SEQ ID NO: 5932 - RNA, 20 nt, Artificial sequence
  specific aptamers
ggagaggaguggaugcggcg

SEQ ID NO: 5933 - RNA, 20 nt, Artificial sequence
  specific aptamers
ggagaggaguggaugcggug

SEQ ID NO: 5934 - RNA, 20 nt, Artificial sequence
  specific aptamers
ggagaggaguggauguggag

SEQ ID NO: 5935 - RNA, 20 nt, Artificial sequence
  specific aptamers
ggagaggaguggauguggcg

SEQ ID NO: 5936 - RNA, 20 nt, Artificial sequence
  specific aptamers
ggagaggaguggauguggug

SEQ ID NO: 5937 - RNA, 19 nt, Artificial sequence
  specific aptamers
ggagaggaguggagaggag

SEQ ID NO: 5938 - RNA, 19 nt, Artificial sequence
  specific aptamers
ggagaggaguggagaggcg

SEQ ID NO: 5939 - RNA, 19 nt, Artificial sequence
  specific aptamers
ggagaggaguggagaggug

SEQ ID NO: 5940 - RNA, 19 nt, Artificial sequence
  specific aptamers
ggagaggaguggagcggag

SEQ ID NO: 5941 - RNA, 19 nt, Artificial sequence
  specific aptamers
ggagaggaguggagcggcg

SEQ ID NO: 5942 - RNA, 19 nt, Artificial sequence
  specific aptamers
ggagaggaguggagcggug

SEQ ID NO: 5943 - RNA, 19 nt, Artificial sequence
  specific aptamers
ggagaggaguggaguggag

SEQ ID NO: 5944 - RNA, 19 nt, Artificial sequence
  specific aptamers
ggagaggaguggaguggcg

SEQ ID NO: 5945 - RNA, 19 nt, Artificial sequence
  specific aptamers
ggagaggaguggaguggug

SEQ ID NO: 5946 - RNA, 20 nt, Artificial sequence
  specific aptamers
ggagaggagugguagaggag

SEQ ID NO: 5947 - RNA, 20 nt, Artificial sequence
  specific aptamers
ggagaggagugguagaggcg

SEQ ID NO: 5948 - RNA, 20 nt, Artificial sequence
  specific aptamers
ggagaggagugguagaggug

SEQ ID NO: 5949 - RNA, 20 nt, Artificial sequence
  specific aptamers
ggagaggagugguagcggag

SEQ ID NO: 5950 - RNA, 20 nt, Artificial sequence
  specific aptamers
ggagaggagugguagcggcg

SEQ ID NO: 5951 - RNA, 20 nt, Artificial sequence
  specific aptamers
ggagaggagugguagcggug

SEQ ID NO: 5952 - RNA, 20 nt, Artificial sequence
  specific aptamers
ggagaggagugguaguggag

SEQ ID NO: 5953 - RNA, 20 nt, Artificial sequence
  specific aptamers
ggagaggagugguaguggcg

SEQ ID NO: 5954 - RNA, 20 nt, Artificial sequence
  specific aptamers
ggagaggagugguaguggug

SEQ ID NO: 5955 - RNA, 20 nt, Artificial sequence
  specific aptamers
ggagaggagugguugaggag

SEQ ID NO: 5956 - RNA, 20 nt, Artificial sequence
  specific aptamers
ggagaggagugguugaggcg

SEQ ID NO: 5957 - RNA, 20 nt, Artificial sequence
  specific aptamers
ggagaggagugguugaggug

SEQ ID NO: 5958 - RNA, 20 nt, Artificial sequence
  specific aptamers
ggagaggagugguugcggag

SEQ ID NO: 5959 - RNA, 20 nt, Artificial sequence
  specific aptamers
ggagaggagugguugcggcg

SEQ ID NO: 5960 - RNA, 20 nt, Artificial sequence
  specific aptamers
ggagaggagugguugcggug

SEQ ID NO: 5961 - RNA, 20 nt, Artificial sequence
  specific aptamers
ggagaggagugguuguggag

SEQ ID NO: 5962 - RNA, 20 nt, Artificial sequence
  specific aptamers
ggagaggagugguuguggcg

SEQ ID NO: 5963 - RNA, 20 nt, Artificial sequence
  specific aptamers
ggagaggagugguuguggug

SEQ ID NO: 5964 - RNA, 19 nt, Artificial sequence
  specific aptamers
ggagaggaguggugaggag

SEQ ID NO: 5965 - RNA, 19 nt, Artificial sequence
  specific aptamers
ggagaggaguggugaggcg

SEQ ID NO: 5966 - RNA, 19 nt, Artificial sequence
  specific aptamers
ggagaggaguggugaggug

SEQ ID NO: 5967 - RNA, 19 nt, Artificial sequence
  specific aptamers
ggagaggaguggugcggag

SEQ ID NO: 5968 - RNA, 19 nt, Artificial sequence
  specific aptamers
ggagaggaguggugcggcg

SEQ ID NO: 5969 - RNA, 19 nt, Artificial sequence
  specific aptamers
ggagaggaguggugcggug

SEQ ID NO: 5970 - RNA, 19 nt, Artificial sequence
  specific aptamers
ggagaggagugguguggag

SEQ ID NO: 5971 - RNA, 19 nt, Artificial sequence
  specific aptamers
ggagaggagugguguggcg

SEQ ID NO: 5972 - RNA, 19 nt, Artificial sequence
  specific aptamers
ggagaggagugguguggug

SEQ ID NO: 5973 - RNA, 20 nt, Artificial sequence
  specific aptamers
ggagaggugaggaagaggag

SEQ ID NO: 5974 - RNA, 20 nt, Artificial sequence
  specific aptamers
ggagaggugaggaagaggcg

SEQ ID NO: 5975 - RNA, 20 nt, Artificial sequence
  specific aptamers
ggagaggugaggaagaggug

SEQ ID NO: 5976 - RNA, 20 nt, Artificial sequence
  specific aptamers
ggagaggugaggaagcggag

SEQ ID NO: 5977 - RNA, 20 nt, Artificial sequence
  specific aptamers
ggagaggugaggaagcggcg

SEQ ID NO: 5978 - RNA, 20 nt, Artificial sequence
  specific aptamers
ggagaggugaggaagcggug

SEQ ID NO: 5979 - RNA, 20 nt, Artificial sequence
  specific aptamers
ggagaggugaggaaguggag

SEQ ID NO: 5980 - RNA, 20 nt, Artificial sequence
  specific aptamers
ggagaggugaggaaguggcg

SEQ ID NO: 5981 - RNA, 20 nt, Artificial sequence
  specific aptamers
ggagaggugaggaaguggug

SEQ ID NO: 5982 - RNA, 20 nt, Artificial sequence
  specific aptamers
ggagaggugaggaugaggag

SEQ ID NO: 5983 - RNA, 20 nt, Artificial sequence
  specific aptamers
ggagaggugaggaugaggcg

SEQ ID NO: 5984 - RNA, 20 nt, Artificial sequence
  specific aptamers
ggagaggugaggaugaggug

SEQ ID NO: 5985 - RNA, 20 nt, Artificial sequence
  specific aptamers
ggagaggugaggaugcggag

SEQ ID NO: 5986 - RNA, 20 nt, Artificial sequence
  specific aptamers
ggagaggugaggaugcggcg

SEQ ID NO: 5987 - RNA, 20 nt, Artificial sequence
  specific aptamers
ggagaggugaggaugcggug

SEQ ID NO: 5988 - RNA, 20 nt, Artificial sequence
  specific aptamers
ggagaggugaggauguggag

SEQ ID NO: 5989 - RNA, 20 nt, Artificial sequence
  specific aptamers
ggagaggugaggauguggcg

SEQ ID NO: 5990 - RNA, 20 nt, Artificial sequence
  specific aptamers
ggagaggugaggauguggug

SEQ ID NO: 5991 - RNA, 19 nt, Artificial sequence
  specific aptamers
ggagaggugaggagaggag

SEQ ID NO: 5992 - RNA, 19 nt, Artificial sequence
  specific aptamers
ggagaggugaggagaggcg

SEQ ID NO: 5993 - RNA, 19 nt, Artificial sequence
  specific aptamers
ggagaggugaggagaggug

SEQ ID NO: 5994 - RNA, 19 nt, Artificial sequence
  specific aptamers
ggagaggugaggagcggag

SEQ ID NO: 5995 - RNA, 19 nt, Artificial sequence
  specific aptamers
ggagaggugaggagcggcg

SEQ ID NO: 5996 - RNA, 19 nt, Artificial sequence
  specific aptamers
ggagaggugaggagcggug

SEQ ID NO: 5997 - RNA, 19 nt, Artificial sequence
  specific aptamers
ggagaggugaggaguggag

SEQ ID NO: 5998 - RNA, 19 nt, Artificial sequence
  specific aptamers
ggagaggugaggaguggcg

SEQ ID NO: 5999 - RNA, 19 nt, Artificial sequence
  specific aptamers
ggagaggugaggaguggug

SEQ ID NO: 6000 - RNA, 20 nt, Artificial sequence
  specific aptamers
ggagaggugagguagaggag

SEQ ID NO: 6001 - RNA, 20 nt, Artificial sequence
  specific aptamers
ggagaggugagguagaggcg

SEQ ID NO: 6002 - RNA, 20 nt, Artificial sequence
  specific aptamers
ggagaggugagguagaggug

SEQ ID NO: 6003 - RNA, 20 nt, Artificial sequence
  specific aptamers
ggagaggugagguagcggag

SEQ ID NO: 6004 - RNA, 20 nt, Artificial sequence
  specific aptamers
ggagaggugagguagcggcg

SEQ ID NO: 6005 - RNA, 20 nt, Artificial sequence
  specific aptamers
ggagaggugagguagcggug

SEQ ID NO: 6006 - RNA, 20 nt, Artificial sequence
  specific aptamers
ggagaggugagguaguggag

SEQ ID NO: 6007 - RNA, 20 nt, Artificial sequence
  specific aptamers
ggagaggugagguaguggcg

SEQ ID NO: 6008 - RNA, 20 nt, Artificial sequence
  specific aptamers
ggagaggugagguaguggug

SEQ ID NO: 6009 - RNA, 20 nt, Artificial sequence
  specific aptamers
ggagaggugagguugaggag

SEQ ID NO: 6010 - RNA, 20 nt, Artificial sequence
  specific aptamers
ggagaggugagguugaggcg

SEQ ID NO: 6011 - RNA, 20 nt, Artificial sequence
  specific aptamers
ggagaggugagguugaggug

SEQ ID NO: 6012 - RNA, 20 nt, Artificial sequence
  specific aptamers
ggagaggugagguugcggag

SEQ ID NO: 6013 - RNA, 20 nt, Artificial sequence
  specific aptamers
ggagaggugagguugcggcg

SEQ ID NO: 6014 - RNA, 20 nt, Artificial sequence
  specific aptamers
ggagaggugagguugcggug

SEQ ID NO: 6015 - RNA, 20 nt, Artificial sequence
  specific aptamers
ggagaggugagguuguggag

SEQ ID NO: 6016 - RNA, 20 nt, Artificial sequence
  specific aptamers
ggagaggugagguuguggcg

SEQ ID NO: 6017 - RNA, 20 nt, Artificial sequence
  specific aptamers
ggagaggugagguuguggug

SEQ ID NO: 6018 - RNA, 19 nt, Artificial sequence
  specific aptamers
ggagaggugaggugaggag

SEQ ID NO: 6019 - RNA, 19 nt, Artificial sequence
  specific aptamers
ggagaggugaggugaggcg

SEQ ID NO: 6020 - RNA, 19 nt, Artificial sequence
  specific aptamers
ggagaggugaggugaggug

SEQ ID NO: 6021 - RNA, 19 nt, Artificial sequence
  specific aptamers
ggagaggugaggugcggag

SEQ ID NO: 6022 - RNA, 19 nt, Artificial sequence
  specific aptamers
ggagaggugaggugcggcg

SEQ ID NO: 6023 - RNA, 19 nt, Artificial sequence
  specific aptamers
ggagaggugaggugcggug

SEQ ID NO: 6024 - RNA, 19 nt, Artificial sequence
  specific aptamers
ggagaggugagguguggag

SEQ ID NO: 6025 - RNA, 19 nt, Artificial sequence
  specific aptamers
ggagaggugagguguggcg

SEQ ID NO: 6026 - RNA, 19 nt, Artificial sequence
  specific aptamers
ggagaggugagguguggug

SEQ ID NO: 6027 - RNA, 20 nt, Artificial sequence
  specific aptamers
ggagagguguggaagaggag

SEQ ID NO: 6028 - RNA, 20 nt, Artificial sequence
  specific aptamers
ggagagguguggaagaggcg

SEQ ID NO: 6029 - RNA, 20 nt, Artificial sequence
  specific aptamers
ggagagguguggaagaggug

SEQ ID NO: 6030 - RNA, 20 nt, Artificial sequence
  specific aptamers
ggagagguguggaagcggag

SEQ ID NO: 6031 - RNA, 20 nt, Artificial sequence
  specific aptamers
ggagagguguggaagcggcg

SEQ ID NO: 6032 - RNA, 20 nt, Artificial sequence
  specific aptamers
ggagagguguggaagcggug

SEQ ID NO: 6033 - RNA, 20 nt, Artificial sequence
  specific aptamers
ggagagguguggaaguggag

SEQ ID NO: 6034 - RNA, 20 nt, Artificial sequence
  specific aptamers
ggagagguguggaaguggcg

SEQ ID NO: 6035 - RNA, 20 nt, Artificial sequence
  specific aptamers
ggagagguguggaaguggug

SEQ ID NO: 6036 - RNA, 20 nt, Artificial sequence
  specific aptamers
ggagagguguggaugaggag

SEQ ID NO: 6037 - RNA, 20 nt, Artificial sequence
  specific aptamers
ggagagguguggaugaggcg

SEQ ID NO: 6038 - RNA, 20 nt, Artificial sequence
  specific aptamers
ggagagguguggaugaggug

SEQ ID NO: 6039 - RNA, 20 nt, Artificial sequence
  specific aptamers
ggagagguguggaugcggag

SEQ ID NO: 6040 - RNA, 20 nt, Artificial sequence
  specific aptamers
ggagagguguggaugcggcg

SEQ ID NO: 6041 - RNA, 20 nt, Artificial sequence
  specific aptamers
ggagagguguggaugcggug

SEQ ID NO: 6042 - RNA, 20 nt, Artificial sequence
  specific aptamers
ggagagguguggauguggag

SEQ ID NO: 6043 - RNA, 20 nt, Artificial sequence
  specific aptamers
ggagagguguggauguggcg

SEQ ID NO: 6044 - RNA, 20 nt, Artificial sequence
  specific aptamers
ggagagguguggauguggug

SEQ ID NO: 6045 - RNA, 19 nt, Artificial sequence
  specific aptamers
ggagagguguggagaggag

SEQ ID NO: 6046 - RNA, 19 nt, Artificial sequence
  specific aptamers
ggagagguguggagaggcg

SEQ ID NO: 6047 - RNA, 19 nt, Artificial sequence
  specific aptamers
ggagagguguggagaggug

SEQ ID NO: 6048 - RNA, 19 nt, Artificial sequence
  specific aptamers
ggagagguguggagcggag

SEQ ID NO: 6049 - RNA, 19 nt, Artificial sequence
  specific aptamers
ggagagguguggagcggcg

SEQ ID NO: 6050 - RNA, 19 nt, Artificial sequence
  specific aptamers
ggagagguguggagcggug

SEQ ID NO: 6051 - RNA, 19 nt, Artificial sequence
  specific aptamers
ggagagguguggaguggag

SEQ ID NO: 6052 - RNA, 19 nt, Artificial sequence
  specific aptamers
ggagagguguggaguggcg

SEQ ID NO: 6053 - RNA, 19 nt, Artificial sequence
  specific aptamers
ggagagguguggaguggug

SEQ ID NO: 6054 - RNA, 20 nt, Artificial sequence
  specific aptamers
ggagaggugugguagaggag

SEQ ID NO: 6055 - RNA, 20 nt, Artificial sequence
  specific aptamers
ggagaggugugguagaggcg

SEQ ID NO: 6056 - RNA, 20 nt, Artificial sequence
  specific aptamers
ggagaggugugguagaggug

SEQ ID NO: 6057 - RNA, 20 nt, Artificial sequence
  specific aptamers
ggagaggugugguagcggag

SEQ ID NO: 6058 - RNA, 20 nt, Artificial sequence
  specific aptamers
ggagaggugugguagcggcg

SEQ ID NO: 6059 - RNA, 20 nt, Artificial sequence
  specific aptamers
ggagaggugugguagcggug

SEQ ID NO: 6060 - RNA, 20 nt, Artificial sequence
  specific aptamers
ggagaggugugguaguggag

SEQ ID NO: 6061 - RNA, 20 nt, Artificial sequence
  specific aptamers
ggagaggugugguaguggcg

SEQ ID NO: 6062 - RNA, 20 nt, Artificial sequence
  specific aptamers
ggagaggugugguaguggug

SEQ ID NO: 6063 - RNA, 20 nt, Artificial sequence
  specific aptamers
ggagaggugugguugaggag

SEQ ID NO: 6064 - RNA, 20 nt, Artificial sequence
  specific aptamers
ggagaggugugguugaggcg

SEQ ID NO: 6065 - RNA, 20 nt, Artificial sequence
  specific aptamers
ggagaggugugguugaggug

SEQ ID NO: 6066 - RNA, 20 nt, Artificial sequence
  specific aptamers
ggagaggugugguugcggag

SEQ ID NO: 6067 - RNA, 20 nt, Artificial sequence
  specific aptamers
ggagaggugugguugcggcg

SEQ ID NO: 6068 - RNA, 20 nt, Artificial sequence
  specific aptamers
ggagaggugugguugcggug

SEQ ID NO: 6069 - RNA, 20 nt, Artificial sequence
  specific aptamers
ggagaggugugguuguggag

SEQ ID NO: 6070 - RNA, 20 nt, Artificial sequence
  specific aptamers
ggagaggugugguuguggcg

SEQ ID NO: 6071 - RNA, 20 nt, Artificial sequence
  specific aptamers
ggagaggugugguuguggug

SEQ ID NO: 6072 - RNA, 19 nt, Artificial sequence
  specific aptamers
ggagagguguggugaggag

SEQ ID NO: 6073 - RNA, 19 nt, Artificial sequence
  specific aptamers
ggagagguguggugaggcg

SEQ ID NO: 6074 - RNA, 19 nt, Artificial sequence
  specific aptamers
ggagagguguggugaggug

SEQ ID NO: 6075 - RNA, 19 nt, Artificial sequence
  specific aptamers
ggagagguguggugcggag

SEQ ID NO: 6076 - RNA, 19 nt, Artificial sequence
  specific aptamers
ggagagguguggugcggcg

SEQ ID NO: 6077 - RNA, 19 nt, Artificial sequence
  specific aptamers
ggagagguguggugcggug

SEQ ID NO: 6078 - RNA, 19 nt, Artificial sequence
  specific aptamers
ggagaggugugguguggag

SEQ ID NO: 6079 - RNA, 19 nt, Artificial sequence
  specific aptamers
ggagaggugugguguggcg

SEQ ID NO: 6080 - RNA, 19 nt, Artificial sequence
  specific aptamers
ggagaggugugguguggug

SEQ ID NO: 6081 - RNA, 20 nt, Artificial sequence
  specific aptamers
ggaguggagaggaagaggag

SEQ ID NO: 6082 - RNA, 20 nt, Artificial sequence
  specific aptamers
ggaguggagaggaagaggcg

SEQ ID NO: 6083 - RNA, 20 nt, Artificial sequence
  specific aptamers
ggaguggagaggaagaggug

SEQ ID NO: 6084 - RNA, 20 nt, Artificial sequence
  specific aptamers
ggaguggagaggaagcggag

SEQ ID NO: 6085 - RNA, 20 nt, Artificial sequence
  specific aptamers
ggaguggagaggaagcggcg

SEQ ID NO: 6086 - RNA, 20 nt, Artificial sequence
  specific aptamers
ggaguggagaggaagcggug

SEQ ID NO: 6087 - RNA, 20 nt, Artificial sequence
  specific aptamers
ggaguggagaggaaguggag

SEQ ID NO: 6088 - RNA, 20 nt, Artificial sequence
  specific aptamers
ggaguggagaggaaguggcg

SEQ ID NO: 6089 - RNA, 20 nt, Artificial sequence
  specific aptamers
ggaguggagaggaaguggug

SEQ ID NO: 6090 - RNA, 20 nt, Artificial sequence
  specific aptamers
ggaguggagaggaugaggag

SEQ ID NO: 6091 - RNA, 20 nt, Artificial sequence
  specific aptamers
ggaguggagaggaugaggcg

SEQ ID NO: 6092 - RNA, 20 nt, Artificial sequence
  specific aptamers
ggaguggagaggaugaggug

SEQ ID NO: 6093 - RNA, 20 nt, Artificial sequence
  specific aptamers
ggaguggagaggaugcggag

SEQ ID NO: 6094 - RNA, 20 nt, Artificial sequence
  specific aptamers
ggaguggagaggaugcggcg

SEQ ID NO: 6095 - RNA, 20 nt, Artificial sequence
  specific aptamers
ggaguggagaggaugcggug

SEQ ID NO: 6096 - RNA, 20 nt, Artificial sequence
  specific aptamers
ggaguggagaggauguggag

SEQ ID NO: 6097 - RNA, 20 nt, Artificial sequence
  specific aptamers
ggaguggagaggauguggcg

SEQ ID NO: 6098 - RNA, 20 nt, Artificial sequence
  specific aptamers
ggaguggagaggauguggug

SEQ ID NO: 6099 - RNA, 19 nt, Artificial sequence
  specific aptamers
ggaguggagaggagaggag

SEQ ID NO: 6100 - RNA, 19 nt, Artificial sequence
  specific aptamers
ggaguggagaggagaggcg

SEQ ID NO: 6101 - RNA, 19 nt, Artificial sequence
  specific aptamers
ggaguggagaggagaggug

SEQ ID NO: 6102 - RNA, 19 nt, Artificial sequence
  specific aptamers
ggaguggagaggagcggag

SEQ ID NO: 6103 - RNA, 19 nt, Artificial sequence
  specific aptamers
ggaguggagaggagcggcg

SEQ ID NO: 6104 - RNA, 19 nt, Artificial sequence
  specific aptamers
ggaguggagaggagcggug

SEQ ID NO: 6105 - RNA, 19 nt, Artificial sequence
  specific aptamers
ggaguggagaggaguggag

SEQ ID NO: 6106 - RNA, 19 nt, Artificial sequence
  specific aptamers
ggaguggagaggaguggcg

SEQ ID NO: 6107 - RNA, 19 nt, Artificial sequence
  specific aptamers
ggaguggagaggaguggug

SEQ ID NO: 6108 - RNA, 20 nt, Artificial sequence
  specific aptamers
ggaguggagagguagaggag

SEQ ID NO: 6109 - RNA, 20 nt, Artificial sequence
  specific aptamers
ggaguggagagguagaggcg

SEQ ID NO: 6110 - RNA, 20 nt, Artificial sequence
  specific aptamers
ggaguggagagguagaggug

SEQ ID NO: 6111 - RNA, 20 nt, Artificial sequence
  specific aptamers
ggaguggagagguagcggag

SEQ ID NO: 6112 - RNA, 20 nt, Artificial sequence
  specific aptamers
ggaguggagagguagcggcg

SEQ ID NO: 6113 - RNA, 20 nt, Artificial sequence
  specific aptamers
ggaguggagagguagcggug

SEQ ID NO: 6114 - RNA, 20 nt, Artificial sequence
  specific aptamers
ggaguggagagguaguggag

SEQ ID NO: 6115 - RNA, 20 nt, Artificial sequence
  specific aptamers
ggaguggagagguaguggcg

SEQ ID NO: 6116 - RNA, 20 nt, Artificial sequence
  specific aptamers
ggaguggagagguaguggug

SEQ ID NO: 6117 - RNA, 20 nt, Artificial sequence
  specific aptamers
ggaguggagagguugaggag

SEQ ID NO: 6118 - RNA, 20 nt, Artificial sequence
  specific aptamers
ggaguggagagguugaggcg

SEQ ID NO: 6119 - RNA, 20 nt, Artificial sequence
  specific aptamers
ggaguggagagguugaggug

SEQ ID NO: 6120 - RNA, 20 nt, Artificial sequence
  specific aptamers
ggaguggagagguugcggag

SEQ ID NO: 6121 - RNA, 20 nt, Artificial sequence
  specific aptamers
ggaguggagagguugcggcg

SEQ ID NO: 6122 - RNA, 20 nt, Artificial sequence
  specific aptamers
ggaguggagagguugcggug

SEQ ID NO: 6123 - RNA, 20 nt, Artificial sequence
  specific aptamers
ggaguggagagguuguggag

SEQ ID NO: 6124 - RNA, 20 nt, Artificial sequence
  specific aptamers
ggaguggagagguuguggcg

SEQ ID NO: 6125 - RNA, 20 nt, Artificial sequence
  specific aptamers
ggaguggagagguuguggug

SEQ ID NO: 6126 - RNA, 19 nt, Artificial sequence
  specific aptamers
ggaguggagaggugaggag

SEQ ID NO: 6127 - RNA, 19 nt, Artificial sequence
  specific aptamers
ggaguggagaggugaggcg

SEQ ID NO: 6128 - RNA, 19 nt, Artificial sequence
  specific aptamers
ggaguggagaggugaggug

SEQ ID NO: 6129 - RNA, 19 nt, Artificial sequence
  specific aptamers
ggaguggagaggugcggag

SEQ ID NO: 6130 - RNA, 19 nt, Artificial sequence
  specific aptamers
ggaguggagaggugcggcg

SEQ ID NO: 6131 - RNA, 19 nt, Artificial sequence
  specific aptamers
ggaguggagaggugcggug

SEQ ID NO: 6132 - RNA, 19 nt, Artificial sequence
  specific aptamers
ggaguggagagguguggag

SEQ ID NO: 6133 - RNA, 19 nt, Artificial sequence
  specific aptamers
ggaguggagagguguggcg

SEQ ID NO: 6134 - RNA, 19 nt, Artificial sequence
  specific aptamers
ggaguggagagguguggug

SEQ ID NO: 6135 - RNA, 20 nt, Artificial sequence
  specific aptamers
ggaguggaguggaagaggag

SEQ ID NO: 6136 - RNA, 20 nt, Artificial sequence
  specific aptamers
ggaguggaguggaagaggcg

SEQ ID NO: 6137 - RNA, 20 nt, Artificial sequence
  specific aptamers
ggaguggaguggaagaggug

SEQ ID NO: 6138 - RNA, 20 nt, Artificial sequence
  specific aptamers
ggaguggaguggaagcggag

SEQ ID NO: 6139 - RNA, 20 nt, Artificial sequence
  specific aptamers
ggaguggaguggaagcggcg

SEQ ID NO: 6140 - RNA, 20 nt, Artificial sequence
  specific aptamers
ggaguggaguggaagcggug

SEQ ID NO: 6141 - RNA, 20 nt, Artificial sequence
  specific aptamers
ggaguggaguggaaguggag

SEQ ID NO: 6142 - RNA, 20 nt, Artificial sequence
  specific aptamers
ggaguggaguggaaguggcg

SEQ ID NO: 6143 - RNA, 20 nt, Artificial sequence
  specific aptamers
ggaguggaguggaaguggug

SEQ ID NO: 6144 - RNA, 20 nt, Artificial sequence
  specific aptamers
ggaguggaguggaugaggag

SEQ ID NO: 6145 - RNA, 20 nt, Artificial sequence
  specific aptamers
ggaguggaguggaugaggcg

SEQ ID NO: 6146 - RNA, 20 nt, Artificial sequence
  specific aptamers
ggaguggaguggaugaggug

SEQ ID NO: 6147 - RNA, 20 nt, Artificial sequence
  specific aptamers
ggaguggaguggaugcggag

SEQ ID NO: 6148 - RNA, 20 nt, Artificial sequence
  specific aptamers
ggaguggaguggaugcggcg

SEQ ID NO: 6149 - RNA, 20 nt, Artificial sequence
  specific aptamers
ggaguggaguggaugcggug

SEQ ID NO: 6150 - RNA, 20 nt, Artificial sequence
  specific aptamers
ggaguggaguggauguggag

SEQ ID NO: 6151 - RNA, 20 nt, Artificial sequence
  specific aptamers
ggaguggaguggauguggcg

SEQ ID NO: 6152 - RNA, 20 nt, Artificial sequence
  specific aptamers
ggaguggaguggauguggug

SEQ ID NO: 6153 - RNA, 19 nt, Artificial sequence
  specific aptamers
ggaguggaguggagaggag

SEQ ID NO: 6154 - RNA, 19 nt, Artificial sequence
  specific aptamers
ggaguggaguggagaggcg

SEQ ID NO: 6155 - RNA, 19 nt, Artificial sequence
  specific aptamers
ggaguggaguggagaggug

SEQ ID NO: 6156 - RNA, 19 nt, Artificial sequence
  specific aptamers
ggaguggaguggagcggag

SEQ ID NO: 6157 - RNA, 19 nt, Artificial sequence
  specific aptamers
ggaguggaguggagcggcg

SEQ ID NO: 6158 - RNA, 19 nt, Artificial sequence
  specific aptamers
ggaguggaguggagcggug

SEQ ID NO: 6159 - RNA, 19 nt, Artificial sequence
  specific aptamers
ggaguggaguggaguggag

SEQ ID NO: 6160 - RNA, 19 nt, Artificial sequence
  specific aptamers
ggaguggaguggaguggcg

SEQ ID NO: 6161 - RNA, 19 nt, Artificial sequence
  specific aptamers
ggaguggaguggaguggug

SEQ ID NO: 6162 - RNA, 20 nt, Artificial sequence
  specific aptamers
ggaguggagugguagaggag

SEQ ID NO: 6163 - RNA, 20 nt, Artificial sequence
  specific aptamers
ggaguggagugguagaggcg

SEQ ID NO: 6164 - RNA, 20 nt, Artificial sequence
  specific aptamers
ggaguggagugguagaggug

SEQ ID NO: 6165 - RNA, 20 nt, Artificial sequence
  specific aptamers
ggaguggagugguagcggag

SEQ ID NO: 6166 - RNA, 20 nt, Artificial sequence
  specific aptamers
ggaguggagugguagcggcg

SEQ ID NO: 6167 - RNA, 20 nt, Artificial sequence
  specific aptamers
ggaguggagugguagcggug

SEQ ID NO: 6168 - RNA, 20 nt, Artificial sequence
  specific aptamers
ggaguggagugguaguggag

SEQ ID NO: 6169 - RNA, 20 nt, Artificial sequence
  specific aptamers
ggaguggagugguaguggcg

SEQ ID NO: 6170 - RNA, 20 nt, Artificial sequence
  specific aptamers
ggaguggagugguaguggug

SEQ ID NO: 6171 - RNA, 20 nt, Artificial sequence
  specific aptamers
ggaguggagugguugaggag

SEQ ID NO: 6172 - RNA, 20 nt, Artificial sequence
  specific aptamers
ggaguggagugguugaggcg

SEQ ID NO: 6173 - RNA, 20 nt, Artificial sequence
  specific aptamers
ggaguggagugguugaggug

SEQ ID NO: 6174 - RNA, 20 nt, Artificial sequence
  specific aptamers
ggaguggagugguugcggag

SEQ ID NO: 6175 - RNA, 20 nt, Artificial sequence
  specific aptamers
ggaguggagugguugcggcg

SEQ ID NO: 6176 - RNA, 20 nt, Artificial sequence
  specific aptamers
ggaguggagugguugcggug

SEQ ID NO: 6177 - RNA, 20 nt, Artificial sequence
  specific aptamers
ggaguggagugguuguggag

SEQ ID NO: 6178 - RNA, 20 nt, Artificial sequence
  specific aptamers
ggaguggagugguuguggcg

SEQ ID NO: 6179 - RNA, 20 nt, Artificial sequence
  specific aptamers
ggaguggagugguuguggug

SEQ ID NO: 6180 - RNA, 19 nt, Artificial sequence
  specific aptamers
ggaguggaguggugaggag

SEQ ID NO: 6181 - RNA, 19 nt, Artificial sequence
  specific aptamers
ggaguggaguggugaggcg

SEQ ID NO: 6182 - RNA, 19 nt, Artificial sequence
  specific aptamers
ggaguggaguggugaggug

SEQ ID NO: 6183 - RNA, 19 nt, Artificial sequence
  specific aptamers
ggaguggaguggugcggag

SEQ ID NO: 6184 - RNA, 19 nt, Artificial sequence
  specific aptamers
ggaguggaguggugcggcg

SEQ ID NO: 6185 - RNA, 19 nt, Artificial sequence
  specific aptamers
ggaguggaguggugcggug

SEQ ID NO: 6186 - RNA, 19 nt, Artificial sequence
  specific aptamers
ggaguggagugguguggag

SEQ ID NO: 6187 - RNA, 19 nt, Artificial sequence
  specific aptamers
ggaguggagugguguggcg

SEQ ID NO: 6188 - RNA, 19 nt, Artificial sequence
  specific aptamers
ggaguggagugguguggug

SEQ ID NO: 6189 - RNA, 20 nt, Artificial sequence
  specific aptamers
ggaguggugaggaagaggag

SEQ ID NO: 6190 - RNA, 20 nt, Artificial sequence
  specific aptamers
ggaguggugaggaagaggcg

SEQ ID NO: 6191 - RNA, 20 nt, Artificial sequence
  specific aptamers
ggaguggugaggaagaggug

SEQ ID NO: 6192 - RNA, 20 nt, Artificial sequence
  specific aptamers
ggaguggugaggaagcggag

SEQ ID NO: 6193 - RNA, 20 nt, Artificial sequence
  specific aptamers
ggaguggugaggaagcggcg

SEQ ID NO: 6194 - RNA, 20 nt, Artificial sequence
  specific aptamers
ggaguggugaggaagcggug

SEQ ID NO: 6195 - RNA, 20 nt, Artificial sequence
  specific aptamers
ggaguggugaggaaguggag

SEQ ID NO: 6196 - RNA, 20 nt, Artificial sequence
  specific aptamers
ggaguggugaggaaguggcg

SEQ ID NO: 6197 - RNA, 20 nt, Artificial sequence
  specific aptamers
ggaguggugaggaaguggug

SEQ ID NO: 6198 - RNA, 20 nt, Artificial sequence
  specific aptamers
ggaguggugaggaugaggag

SEQ ID NO: 6199 - RNA, 20 nt, Artificial sequence
  specific aptamers
ggaguggugaggaugaggcg

SEQ ID NO: 6200 - RNA, 20 nt, Artificial sequence
  specific aptamers
ggaguggugaggaugaggug

SEQ ID NO: 6201 - RNA, 20 nt, Artificial sequence
  specific aptamers
ggaguggugaggaugcggag

SEQ ID NO: 6202 - RNA, 20 nt, Artificial sequence
  specific aptamers
ggaguggugaggaugcggcg

SEQ ID NO: 6203 - RNA, 20 nt, Artificial sequence
  specific aptamers
ggaguggugaggaugcggug

SEQ ID NO: 6204 - RNA, 20 nt, Artificial sequence
  specific aptamers
ggaguggugaggauguggag

SEQ ID NO: 6205 - RNA, 20 nt, Artificial sequence
  specific aptamers
ggaguggugaggauguggcg

SEQ ID NO: 6206 - RNA, 20 nt, Artificial sequence
  specific aptamers
ggaguggugaggauguggug

SEQ ID NO: 6207 - RNA, 19 nt, Artificial sequence
  specific aptamers
ggaguggugaggagaggag

SEQ ID NO: 6208 - RNA, 19 nt, Artificial sequence
  specific aptamers
ggaguggugaggagaggcg

SEQ ID NO: 6209 - RNA, 19 nt, Artificial sequence
  specific aptamers
ggaguggugaggagaggug

SEQ ID NO: 6210 - RNA, 19 nt, Artificial sequence
  specific aptamers
ggaguggugaggagcggag

SEQ ID NO: 6211 - RNA, 19 nt, Artificial sequence
  specific aptamers
ggaguggugaggagcggcg

SEQ ID NO: 6212 - RNA, 19 nt, Artificial sequence
  specific aptamers
ggaguggugaggagcggug

SEQ ID NO: 6213 - RNA, 19 nt, Artificial sequence
  specific aptamers
ggaguggugaggaguggag

SEQ ID NO: 6214 - RNA, 19 nt, Artificial sequence
  specific aptamers
ggaguggugaggaguggcg

SEQ ID NO: 6215 - RNA, 19 nt, Artificial sequence
  specific aptamers
ggaguggugaggaguggug

SEQ ID NO: 6216 - RNA, 20 nt, Artificial sequence
  specific aptamers
ggaguggugagguagaggag

SEQ ID NO: 6217 - RNA, 20 nt, Artificial sequence
  specific aptamers
ggaguggugagguagaggcg

SEQ ID NO: 6218 - RNA, 20 nt, Artificial sequence
  specific aptamers
ggaguggugagguagaggug

SEQ ID NO: 6219 - RNA, 20 nt, Artificial sequence
  specific aptamers
ggaguggugagguagcggag

SEQ ID NO: 6220 - RNA, 20 nt, Artificial sequence
  specific aptamers
ggaguggugagguagcggcg

SEQ ID NO: 6221 - RNA, 20 nt, Artificial sequence
  specific aptamers
ggaguggugagguagcggug

SEQ ID NO: 6222 - RNA, 20 nt, Artificial sequence
  specific aptamers
ggaguggugagguaguggag

SEQ ID NO: 6223 - RNA, 20 nt, Artificial sequence
  specific aptamers
ggaguggugagguaguggcg

SEQ ID NO: 6224 - RNA, 20 nt, Artificial sequence
  specific aptamers
ggaguggugagguaguggug

SEQ ID NO: 6225 - RNA, 20 nt, Artificial sequence
  specific aptamers
ggaguggugagguugaggag

SEQ ID NO: 6226 - RNA, 20 nt, Artificial sequence
  specific aptamers
ggaguggugagguugaggcg

SEQ ID NO: 6227 - RNA, 20 nt, Artificial sequence
  specific aptamers
ggaguggugagguugaggug

SEQ ID NO: 6228 - RNA, 20 nt, Artificial sequence
  specific aptamers
ggaguggugagguugcggag

SEQ ID NO: 6229 - RNA, 20 nt, Artificial sequence
  specific aptamers
ggaguggugagguugcggcg

SEQ ID NO: 6230 - RNA, 20 nt, Artificial sequence
  specific aptamers
ggaguggugagguugcggug

SEQ ID NO: 6231 - RNA, 20 nt, Artificial sequence
  specific aptamers
ggaguggugagguuguggag

SEQ ID NO: 6232 - RNA, 20 nt, Artificial sequence
  specific aptamers
ggaguggugagguuguggcg

SEQ ID NO: 6233 - RNA, 20 nt, Artificial sequence
  specific aptamers
ggaguggugagguuguggug

SEQ ID NO: 6234 - RNA, 19 nt, Artificial sequence
  specific aptamers
ggaguggugaggugaggag

SEQ ID NO: 6235 - RNA, 19 nt, Artificial sequence
  specific aptamers
ggaguggugaggugaggcg

SEQ ID NO: 6236 - RNA, 19 nt, Artificial sequence
  specific aptamers
ggaguggugaggugaggug

SEQ ID NO: 6237 - RNA, 19 nt, Artificial sequence
  specific aptamers
ggaguggugaggugcggag

SEQ ID NO: 6238 - RNA, 19 nt, Artificial sequence
  specific aptamers
ggaguggugaggugcggcg

SEQ ID NO: 6239 - RNA, 19 nt, Artificial sequence
  specific aptamers
ggaguggugaggugcggug

SEQ ID NO: 6240 - RNA, 19 nt, Artificial sequence
  specific aptamers
ggaguggugagguguggag

SEQ ID NO: 6241 - RNA, 19 nt, Artificial sequence
  specific aptamers
ggaguggugagguguggcg

SEQ ID NO: 6242 - RNA, 19 nt, Artificial sequence
  specific aptamers
ggaguggugagguguggug

SEQ ID NO: 6243 - RNA, 20 nt, Artificial sequence
  specific aptamers
ggagugguguggaagaggag

SEQ ID NO: 6244 - RNA, 20 nt, Artificial sequence
  specific aptamers
ggagugguguggaagaggcg

SEQ ID NO: 6245 - RNA, 20 nt, Artificial sequence
  specific aptamers
ggagugguguggaagaggug

SEQ ID NO: 6246 - RNA, 20 nt, Artificial sequence
  specific aptamers
ggagugguguggaagcggag

SEQ ID NO: 6247 - RNA, 20 nt, Artificial sequence
  specific aptamers
ggagugguguggaagcggcg

SEQ ID NO: 6248 - RNA, 20 nt, Artificial sequence
  specific aptamers
ggagugguguggaagcggug

SEQ ID NO: 6249 - RNA, 20 nt, Artificial sequence
  specific aptamers
ggagugguguggaaguggag

SEQ ID NO: 6250 - RNA, 20 nt, Artificial sequence
  specific aptamers
ggagugguguggaaguggcg

SEQ ID NO: 6251 - RNA, 20 nt, Artificial sequence
  specific aptamers
ggagugguguggaaguggug

SEQ ID NO: 6252 - RNA, 20 nt, Artificial sequence
  specific aptamers
ggagugguguggaugaggag

SEQ ID NO: 6253 - RNA, 20 nt, Artificial sequence
  specific aptamers
ggagugguguggaugaggcg

SEQ ID NO: 6254 - RNA, 20 nt, Artificial sequence
  specific aptamers
ggagugguguggaugaggug

SEQ ID NO: 6255 - RNA, 20 nt, Artificial sequence
  specific aptamers
ggagugguguggaugcggag

SEQ ID NO: 6256 - RNA, 20 nt, Artificial sequence
  specific aptamers
ggagugguguggaugcggcg

SEQ ID NO: 6257 - RNA, 20 nt, Artificial sequence
  specific aptamers
ggagugguguggaugcggug

SEQ ID NO: 6258 - RNA, 20 nt, Artificial sequence
  specific aptamers
ggagugguguggauguggag

SEQ ID NO: 6259 - RNA, 20 nt, Artificial sequence
  specific aptamers
ggagugguguggauguggcg

SEQ ID NO: 6260 - RNA, 20 nt, Artificial sequence
  specific aptamers
ggagugguguggauguggug

SEQ ID NO: 6261 - RNA, 19 nt, Artificial sequence
  specific aptamers
ggagugguguggagaggag

SEQ ID NO: 6262 - RNA, 19 nt, Artificial sequence
  specific aptamers
ggagugguguggagaggcg

SEQ ID NO: 6263 - RNA, 19 nt, Artificial sequence
  specific aptamers
ggagugguguggagaggug

SEQ ID NO: 6264 - RNA, 19 nt, Artificial sequence
  specific aptamers
ggagugguguggagcggag

SEQ ID NO: 6265 - RNA, 19 nt, Artificial sequence
  specific aptamers
ggagugguguggagcggcg

SEQ ID NO: 6266 - RNA, 19 nt, Artificial sequence
  specific aptamers
ggagugguguggagcggug

SEQ ID NO: 6267 - RNA, 19 nt, Artificial sequence
  specific aptamers
ggagugguguggaguggag

SEQ ID NO: 6268 - RNA, 19 nt, Artificial sequence
  specific aptamers
ggagugguguggaguggcg

SEQ ID NO: 6269 - RNA, 19 nt, Artificial sequence
  specific aptamers
ggagugguguggaguggug

SEQ ID NO: 6270 - RNA, 20 nt, Artificial sequence
  specific aptamers
ggaguggugugguagaggag

SEQ ID NO: 6271 - RNA, 20 nt, Artificial sequence
  specific aptamers
ggaguggugugguagaggcg

SEQ ID NO: 6272 - RNA, 20 nt, Artificial sequence
  specific aptamers
ggaguggugugguagaggug

SEQ ID NO: 6273 - RNA, 20 nt, Artificial sequence
  specific aptamers
ggaguggugugguagcggag

SEQ ID NO: 6274 - RNA, 20 nt, Artificial sequence
  specific aptamers
ggaguggugugguagcggcg

SEQ ID NO: 6275 - RNA, 20 nt, Artificial sequence
  specific aptamers
ggaguggugugguagcggug

SEQ ID NO: 6276 - RNA, 20 nt, Artificial sequence
  specific aptamers
ggaguggugugguaguggag

SEQ ID NO: 6277 - RNA, 20 nt, Artificial sequence
  specific aptamers
ggaguggugugguaguggcg

SEQ ID NO: 6278 - RNA, 20 nt, Artificial sequence
  specific aptamers
ggaguggugugguaguggug

SEQ ID NO: 6279 - RNA, 20 nt, Artificial sequence
  specific aptamers
ggaguggugugguugaggag

SEQ ID NO: 6280 - RNA, 20 nt, Artificial sequence
  specific aptamers
ggaguggugugguugaggcg

SEQ ID NO: 6281 - RNA, 20 nt, Artificial sequence
  specific aptamers
ggaguggugugguugaggug

SEQ ID NO: 6282 - RNA, 20 nt, Artificial sequence
  specific aptamers
ggaguggugugguugcggag

SEQ ID NO: 6283 - RNA, 20 nt, Artificial sequence
  specific aptamers
ggaguggugugguugcggcg

SEQ ID NO: 6284 - RNA, 20 nt, Artificial sequence
  specific aptamers
ggaguggugugguugcggug

SEQ ID NO: 6285 - RNA, 20 nt, Artificial sequence
  specific aptamers
ggaguggugugguuguggag

SEQ ID NO: 6286 - RNA, 20 nt, Artificial sequence
  specific aptamers
ggaguggugugguuguggcg

SEQ ID NO: 6287 - RNA, 20 nt, Artificial sequence
  specific aptamers
ggaguggugugguuguggug

SEQ ID NO: 6288 - RNA, 19 nt, Artificial sequence
  specific aptamers
ggagugguguggugaggag

SEQ ID NO: 6289 - RNA, 19 nt, Artificial sequence
  specific aptamers
ggagugguguggugaggcg

SEQ ID NO: 6290 - RNA, 19 nt, Artificial sequence
  specific aptamers
ggagugguguggugaggug

SEQ ID NO: 6291 - RNA, 19 nt, Artificial sequence
  specific aptamers
ggagugguguggugcggag

SEQ ID NO: 6292 - RNA, 19 nt, Artificial sequence
  specific aptamers
ggagugguguggugcggcg

SEQ ID NO: 6293 - RNA, 19 nt, Artificial sequence
  specific aptamers
ggagugguguggugcggug

SEQ ID NO: 6294 - RNA, 19 nt, Artificial sequence
  specific aptamers
ggaguggugugguguggag

SEQ ID NO: 6295 - RNA, 19 nt, Artificial sequence
  specific aptamers
ggaguggugugguguggcg

SEQ ID NO: 6296 - RNA, 19 nt, Artificial sequence
  specific aptamers
ggaguggugugguguggug

SEQ ID NO: 6297 - RNA, 20 nt, Artificial sequence
  specific aptamers
ggugaggagaggaagaggag

SEQ ID NO: 6298 - RNA, 20 nt, Artificial sequence
  specific aptamers
ggugaggagaggaagaggcg

SEQ ID NO: 6299 - RNA, 20 nt, Artificial sequence
  specific aptamers
ggugaggagaggaagaggug

SEQ ID NO: 6300 - RNA, 20 nt, Artificial sequence
  specific aptamers
ggugaggagaggaagcggag

SEQ ID NO: 6301 - RNA, 20 nt, Artificial sequence
  specific aptamers
ggugaggagaggaagcggcg

SEQ ID NO: 6302 - RNA, 20 nt, Artificial sequence
  specific aptamers
ggugaggagaggaagcggug

SEQ ID NO: 6303 - RNA, 20 nt, Artificial sequence
  specific aptamers
ggugaggagaggaaguggag

SEQ ID NO: 6304 - RNA, 20 nt, Artificial sequence
  specific aptamers
ggugaggagaggaaguggcg

SEQ ID NO: 6305 - RNA, 20 nt, Artificial sequence
  specific aptamers
ggugaggagaggaaguggug

SEQ ID NO: 6306 - RNA, 20 nt, Artificial sequence
  specific aptamers
ggugaggagaggaugaggag

SEQ ID NO: 6307 - RNA, 20 nt, Artificial sequence
  specific aptamers
ggugaggagaggaugaggcg

SEQ ID NO: 6308 - RNA, 20 nt, Artificial sequence
  specific aptamers
ggugaggagaggaugaggug

SEQ ID NO: 6309 - RNA, 20 nt, Artificial sequence
  specific aptamers
ggugaggagaggaugcggag

SEQ ID NO: 6310 - RNA, 20 nt, Artificial sequence
  specific aptamers
ggugaggagaggaugcggcg

SEQ ID NO: 6311 - RNA, 20 nt, Artificial sequence
  specific aptamers
ggugaggagaggaugcggug

SEQ ID NO: 6312 - RNA, 20 nt, Artificial sequence
  specific aptamers
ggugaggagaggauguggag

SEQ ID NO: 6313 - RNA, 20 nt, Artificial sequence
  specific aptamers
ggugaggagaggauguggcg

SEQ ID NO: 6314 - RNA, 20 nt, Artificial sequence
  specific aptamers
ggugaggagaggauguggug

SEQ ID NO: 6315 - RNA, 19 nt, Artificial sequence
  specific aptamers
ggugaggagaggagaggcg

SEQ ID NO: 6316 - RNA, 19 nt, Artificial sequence
  specific aptamers
ggugaggagaggagaggug

SEQ ID NO: 6317 - RNA, 19 nt, Artificial sequence
  specific aptamers
ggugaggagaggagcggag

SEQ ID NO: 6318 - RNA, 19 nt, Artificial sequence
  specific aptamers
ggugaggagaggagcggcg

SEQ ID NO: 6319 - RNA, 19 nt, Artificial sequence
  specific aptamers
ggugaggagaggagcggug

SEQ ID NO: 6320 - RNA, 19 nt, Artificial sequence
  specific aptamers
ggugaggagaggaguggag

SEQ ID NO: 6321 - RNA, 19 nt, Artificial sequence
  specific aptamers
ggugaggagaggaguggcg

SEQ ID NO: 6322 - RNA, 19 nt, Artificial sequence
  specific aptamers
ggugaggagaggaguggug

SEQ ID NO: 6323 - RNA, 20 nt, Artificial sequence
  specific aptamers
ggugaggagagguagaggag

SEQ ID NO: 6324 - RNA, 20 nt, Artificial sequence
  specific aptamers
ggugaggagagguagaggcg

SEQ ID NO: 6325 - RNA, 20 nt, Artificial sequence
  specific aptamers
ggugaggagagguagaggug

SEQ ID NO: 6326 - RNA, 20 nt, Artificial sequence
  specific aptamers
ggugaggagagguagcggag

SEQ ID NO: 6327 - RNA, 20 nt, Artificial sequence
  specific aptamers
ggugaggagagguagcggcg

SEQ ID NO: 6328 - RNA, 20 nt, Artificial sequence
  specific aptamers
ggugaggagagguagcggug

SEQ ID NO: 6329 - RNA, 20 nt, Artificial sequence
  specific aptamers
ggugaggagagguaguggag

SEQ ID NO: 6330 - RNA, 20 nt, Artificial sequence
  specific aptamers
ggugaggagagguaguggcg

SEQ ID NO: 6331 - RNA, 20 nt, Artificial sequence
  specific aptamers
ggugaggagagguaguggug

SEQ ID NO: 6332 - RNA, 20 nt, Artificial sequence
  specific aptamers
ggugaggagagguugaggag

SEQ ID NO: 6333 - RNA, 20 nt, Artificial sequence
  specific aptamers
ggugaggagagguugaggcg

SEQ ID NO: 6334 - RNA, 20 nt, Artificial sequence
  specific aptamers
ggugaggagagguugaggug

SEQ ID NO: 6335 - RNA, 20 nt, Artificial sequence
  specific aptamers
ggugaggagagguugcggag

SEQ ID NO: 6336 - RNA, 20 nt, Artificial sequence
  specific aptamers
ggugaggagagguugcggcg

SEQ ID NO: 6337 - RNA, 20 nt, Artificial sequence
  specific aptamers
ggugaggagagguugcggug

SEQ ID NO: 6338 - RNA, 20 nt, Artificial sequence
  specific aptamers
ggugaggagagguuguggag

SEQ ID NO: 6339 - RNA, 20 nt, Artificial sequence
  specific aptamers
ggugaggagagguuguggcg

SEQ ID NO: 6340 - RNA, 20 nt, Artificial sequence
  specific aptamers
ggugaggagagguuguggug

SEQ ID NO: 6341 - RNA, 19 nt, Artificial sequence
  specific aptamers
ggugaggagaggugaggag

SEQ ID NO: 6342 - RNA, 19 nt, Artificial sequence
  specific aptamers
ggugaggagaggugaggcg

SEQ ID NO: 6343 - RNA, 19 nt, Artificial sequence
  specific aptamers
ggugaggagaggugaggug

SEQ ID NO: 6344 - RNA, 19 nt, Artificial sequence
  specific aptamers
ggugaggagaggugcggag

SEQ ID NO: 6345 - RNA, 19 nt, Artificial sequence
  specific aptamers
ggugaggagaggugcggcg

SEQ ID NO: 6346 - RNA, 19 nt, Artificial sequence
  specific aptamers
ggugaggagaggugcggug

SEQ ID NO: 6347 - RNA, 19 nt, Artificial sequence
  specific aptamers
ggugaggagagguguggag

SEQ ID NO: 6348 - RNA, 19 nt, Artificial sequence
  specific aptamers
ggugaggagagguguggcg

SEQ ID NO: 6349 - RNA, 19 nt, Artificial sequence
  specific aptamers
ggugaggagagguguggug

SEQ ID NO: 6350 - RNA, 20 nt, Artificial sequence
  specific aptamers
ggugaggaguggaagaggag

SEQ ID NO: 6351 - RNA, 20 nt, Artificial sequence
  specific aptamers
ggugaggaguggaagaggcg

SEQ ID NO: 6352 - RNA, 20 nt, Artificial sequence
  specific aptamers
ggugaggaguggaagaggug

SEQ ID NO: 6353 - RNA, 20 nt, Artificial sequence
  specific aptamers
ggugaggaguggaagcggag

SEQ ID NO: 6354 - RNA, 20 nt, Artificial sequence
  specific aptamers
ggugaggaguggaagcggcg

SEQ ID NO: 6355 - RNA, 20 nt, Artificial sequence
  specific aptamers
ggugaggaguggaagcggug

SEQ ID NO: 6356 - RNA, 20 nt, Artificial sequence
  specific aptamers
ggugaggaguggaaguggag

SEQ ID NO: 6357 - RNA, 20 nt, Artificial sequence
  specific aptamers
ggugaggaguggaaguggcg

SEQ ID NO: 6358 - RNA, 20 nt, Artificial sequence
  specific aptamers
ggugaggaguggaaguggug

SEQ ID NO: 6359 - RNA, 20 nt, Artificial sequence
  specific aptamers
ggugaggaguggaugaggag

SEQ ID NO: 6360 - RNA, 20 nt, Artificial sequence
  specific aptamers
ggugaggaguggaugaggcg

SEQ ID NO: 6361 - RNA, 20 nt, Artificial sequence
  specific aptamers
ggugaggaguggaugaggug

SEQ ID NO: 6362 - RNA, 20 nt, Artificial sequence
  specific aptamers
ggugaggaguggaugcggag

SEQ ID NO: 6363 - RNA, 20 nt, Artificial sequence
  specific aptamers
ggugaggaguggaugcggcg

SEQ ID NO: 6364 - RNA, 20 nt, Artificial sequence
  specific aptamers
ggugaggaguggaugcggug

SEQ ID NO: 6365 - RNA, 20 nt, Artificial sequence
  specific aptamers
ggugaggaguggauguggag

SEQ ID NO: 6366 - RNA, 20 nt, Artificial sequence
  specific aptamers
ggugaggaguggauguggcg

SEQ ID NO: 6367 - RNA, 20 nt, Artificial sequence
  specific aptamers
ggugaggaguggauguggug

SEQ ID NO: 6368 - RNA, 19 nt, Artificial sequence
  specific aptamers
ggugaggaguggagaggcg

SEQ ID NO: 6369 - RNA, 19 nt, Artificial sequence
  specific aptamers
ggugaggaguggagaggug

SEQ ID NO: 6370 - RNA, 19 nt, Artificial sequence
  specific aptamers
ggugaggaguggagcggag

SEQ ID NO: 6371 - RNA, 19 nt, Artificial sequence
  specific aptamers
ggugaggaguggagcggcg

SEQ ID NO: 6372 - RNA, 19 nt, Artificial sequence
  specific aptamers
ggugaggaguggagcggug

SEQ ID NO: 6373 - RNA, 19 nt, Artificial sequence
  specific aptamers
ggugaggaguggaguggag

SEQ ID NO: 6374 - RNA, 19 nt, Artificial sequence
  specific aptamers
ggugaggaguggaguggcg

SEQ ID NO: 6375 - RNA, 19 nt, Artificial sequence
  specific aptamers
ggugaggaguggaguggug

SEQ ID NO: 6376 - RNA, 20 nt, Artificial sequence
  specific aptamers
ggugaggagugguagaggag

SEQ ID NO: 6377 - RNA, 20 nt, Artificial sequence
  specific aptamers
ggugaggagugguagaggcg

SEQ ID NO: 6378 - RNA, 20 nt, Artificial sequence
  specific aptamers
ggugaggagugguagaggug

SEQ ID NO: 6379 - RNA, 20 nt, Artificial sequence
  specific aptamers
ggugaggagugguagcggag

SEQ ID NO: 6380 - RNA, 20 nt, Artificial sequence
  specific aptamers
ggugaggagugguagcggcg

SEQ ID NO: 6381 - RNA, 20 nt, Artificial sequence
  specific aptamers
ggugaggagugguagcggug

SEQ ID NO: 6382 - RNA, 20 nt, Artificial sequence
  specific aptamers
ggugaggagugguaguggag

SEQ ID NO: 6383 - RNA, 20 nt, Artificial sequence
  specific aptamers
ggugaggagugguaguggcg

SEQ ID NO: 6384 - RNA, 20 nt, Artificial sequence
  specific aptamers
ggugaggagugguaguggug

SEQ ID NO: 6385 - RNA, 20 nt, Artificial sequence
  specific aptamers
ggugaggagugguugaggag

SEQ ID NO: 6386 - RNA, 20 nt, Artificial sequence
  specific aptamers
ggugaggagugguugaggcg

SEQ ID NO: 6387 - RNA, 20 nt, Artificial sequence
  specific aptamers
ggugaggagugguugaggug

SEQ ID NO: 6388 - RNA, 20 nt, Artificial sequence
  specific aptamers
ggugaggagugguugcggag

SEQ ID NO: 6389 - RNA, 20 nt, Artificial sequence
  specific aptamers
ggugaggagugguugcggcg

SEQ ID NO: 6390 - RNA, 20 nt, Artificial sequence
  specific aptamers
ggugaggagugguugcggug

SEQ ID NO: 6391 - RNA, 20 nt, Artificial sequence
  specific aptamers
ggugaggagugguuguggag

SEQ ID NO: 6392 - RNA, 20 nt, Artificial sequence
  specific aptamers
ggugaggagugguuguggcg

SEQ ID NO: 6393 - RNA, 20 nt, Artificial sequence
  specific aptamers
ggugaggagugguuguggug

SEQ ID NO: 6394 - RNA, 19 nt, Artificial sequence
  specific aptamers
ggugaggaguggugaggag

SEQ ID NO: 6395 - RNA, 19 nt, Artificial sequence
  specific aptamers
ggugaggaguggugaggcg

SEQ ID NO: 6396 - RNA, 19 nt, Artificial sequence
  specific aptamers
ggugaggaguggugaggug

SEQ ID NO: 6397 - RNA, 19 nt, Artificial sequence
  specific aptamers
ggugaggaguggugcggag

SEQ ID NO: 6398 - RNA, 19 nt, Artificial sequence
  specific aptamers
ggugaggaguggugcggcg

SEQ ID NO: 6399 - RNA, 19 nt, Artificial sequence
  specific aptamers
ggugaggaguggugcggug

SEQ ID NO: 6400 - RNA, 19 nt, Artificial sequence
  specific aptamers
ggugaggagugguguggag

SEQ ID NO: 6401 - RNA, 19 nt, Artificial sequence
  specific aptamers
ggugaggagugguguggcg

SEQ ID NO: 6402 - RNA, 19 nt, Artificial sequence
  specific aptamers
ggugaggagugguguggug

SEQ ID NO: 6403 - RNA, 20 nt, Artificial sequence
  specific aptamers
ggugaggugaggaagaggag

SEQ ID NO: 6404 - RNA, 20 nt, Artificial sequence
  specific aptamers
ggugaggugaggaagaggcg

SEQ ID NO: 6405 - RNA, 20 nt, Artificial sequence
  specific aptamers
ggugaggugaggaagaggug

SEQ ID NO: 6406 - RNA, 20 nt, Artificial sequence
  specific aptamers
ggugaggugaggaagcggag

SEQ ID NO: 6407 - RNA, 20 nt, Artificial sequence
  specific aptamers
ggugaggugaggaagcggcg

SEQ ID NO: 6408 - RNA, 20 nt, Artificial sequence
  specific aptamers
ggugaggugaggaagcggug

SEQ ID NO: 6409 - RNA, 20 nt, Artificial sequence
  specific aptamers
ggugaggugaggaaguggag

SEQ ID NO: 6410 - RNA, 20 nt, Artificial sequence
  specific aptamers
ggugaggugaggaaguggcg

SEQ ID NO: 6411 - RNA, 20 nt, Artificial sequence
  specific aptamers
ggugaggugaggaaguggug

SEQ ID NO: 6412 - RNA, 20 nt, Artificial sequence
  specific aptamers
ggugaggugaggaugaggag

SEQ ID NO: 6413 - RNA, 20 nt, Artificial sequence
  specific aptamers
ggugaggugaggaugaggcg

SEQ ID NO: 6414 - RNA, 20 nt, Artificial sequence
  specific aptamers
ggugaggugaggaugaggug

SEQ ID NO: 6415 - RNA, 20 nt, Artificial sequence
  specific aptamers
ggugaggugaggaugcggag

SEQ ID NO: 6416 - RNA, 20 nt, Artificial sequence
  specific aptamers
ggugaggugaggaugcggcg

SEQ ID NO: 6417 - RNA, 20 nt, Artificial sequence
  specific aptamers
ggugaggugaggaugcggug

SEQ ID NO: 6418 - RNA, 20 nt, Artificial sequence
  specific aptamers
ggugaggugaggauguggag

SEQ ID NO: 6419 - RNA, 20 nt, Artificial sequence
  specific aptamers
ggugaggugaggauguggcg

SEQ ID NO: 6420 - RNA, 20 nt, Artificial sequence
  specific aptamers
ggugaggugaggauguggug

SEQ ID NO: 6421 - RNA, 19 nt, Artificial sequence
  specific aptamers
ggugaggugaggagaggag

SEQ ID NO: 6422 - RNA, 19 nt, Artificial sequence
  specific aptamers
ggugaggugaggagaggcg

SEQ ID NO: 6423 - RNA, 19 nt, Artificial sequence
  specific aptamers
ggugaggugaggagaggug

SEQ ID NO: 6424 - RNA, 19 nt, Artificial sequence
  specific aptamers
ggugaggugaggagcggag

SEQ ID NO: 6425 - RNA, 19 nt, Artificial sequence
  specific aptamers
ggugaggugaggagcggcg

SEQ ID NO: 6426 - RNA, 19 nt, Artificial sequence
  specific aptamers
ggugaggugaggagcggug

SEQ ID NO: 6427 - RNA, 19 nt, Artificial sequence
  specific aptamers
ggugaggugaggaguggag

SEQ ID NO: 6428 - RNA, 19 nt, Artificial sequence
  specific aptamers
ggugaggugaggaguggcg

SEQ ID NO: 6429 - RNA, 19 nt, Artificial sequence
  specific aptamers
ggugaggugaggaguggug

SEQ ID NO: 6430 - RNA, 20 nt, Artificial sequence
  specific aptamers
ggugaggugagguagaggag

SEQ ID NO: 6431 - RNA, 20 nt, Artificial sequence
  specific aptamers
ggugaggugagguagaggcg

SEQ ID NO: 6432 - RNA, 20 nt, Artificial sequence
  specific aptamers
ggugaggugagguagaggug

SEQ ID NO: 6433 - RNA, 20 nt, Artificial sequence
  specific aptamers
ggugaggugagguagcggag

SEQ ID NO: 6434 - RNA, 20 nt, Artificial sequence
  specific aptamers
ggugaggugagguagcggcg

SEQ ID NO: 6435 - RNA, 20 nt, Artificial sequence
  specific aptamers
ggugaggugagguagcggug

SEQ ID NO: 6436 - RNA, 20 nt, Artificial sequence
  specific aptamers
ggugaggugagguaguggag

SEQ ID NO: 6437 - RNA, 20 nt, Artificial sequence
  specific aptamers
ggugaggugagguaguggcg

SEQ ID NO: 6438 - RNA, 20 nt, Artificial sequence
  specific aptamers
ggugaggugagguaguggug

SEQ ID NO: 6439 - RNA, 20 nt, Artificial sequence
  specific aptamers
ggugaggugagguugaggag

SEQ ID NO: 6440 - RNA, 20 nt, Artificial sequence
  specific aptamers
ggugaggugagguugaggcg

SEQ ID NO: 6441 - RNA, 20 nt, Artificial sequence
  specific aptamers
ggugaggugagguugaggug

SEQ ID NO: 6442 - RNA, 20 nt, Artificial sequence
  specific aptamers
ggugaggugagguugcggag

SEQ ID NO: 6443 - RNA, 20 nt, Artificial sequence
  specific aptamers
ggugaggugagguugcggcg

SEQ ID NO: 6444 - RNA, 20 nt, Artificial sequence
  specific aptamers
ggugaggugagguugcggug

SEQ ID NO: 6445 - RNA, 20 nt, Artificial sequence
  specific aptamers
ggugaggugagguuguggag

SEQ ID NO: 6446 - RNA, 20 nt, Artificial sequence
  specific aptamers
ggugaggugagguuguggcg

SEQ ID NO: 6447 - RNA, 20 nt, Artificial sequence
  specific aptamers
ggugaggugagguuguggug

SEQ ID NO: 6448 - RNA, 19 nt, Artificial sequence
  specific aptamers
ggugaggugaggugaggag

SEQ ID NO: 6449 - RNA, 19 nt, Artificial sequence
  specific aptamers
ggugaggugaggugaggcg

SEQ ID NO: 6450 - RNA, 19 nt, Artificial sequence
  specific aptamers
ggugaggugaggugaggug

SEQ ID NO: 6451 - RNA, 19 nt, Artificial sequence
  specific aptamers
ggugaggugaggugcggag

SEQ ID NO: 6452 - RNA, 19 nt, Artificial sequence
  specific aptamers
ggugaggugaggugcggcg

SEQ ID NO: 6453 - RNA, 19 nt, Artificial sequence
  specific aptamers
ggugaggugaggugcggug

SEQ ID NO: 6454 - RNA, 19 nt, Artificial sequence
  specific aptamers
ggugaggugagguguggag

SEQ ID NO: 6455 - RNA, 19 nt, Artificial sequence
  specific aptamers
ggugaggugagguguggcg

SEQ ID NO: 6456 - RNA, 19 nt, Artificial sequence
  specific aptamers
ggugaggugagguguggug

SEQ ID NO: 6457 - RNA, 20 nt, Artificial sequence
  specific aptamers
ggugagguguggaagaggag

SEQ ID NO: 6458 - RNA, 20 nt, Artificial sequence
  specific aptamers
ggugagguguggaagaggcg

SEQ ID NO: 6459 - RNA, 20 nt, Artificial sequence
  specific aptamers
ggugagguguggaagaggug

SEQ ID NO: 6460 - RNA, 20 nt, Artificial sequence
  specific aptamers
ggugagguguggaagcggag

SEQ ID NO: 6461 - RNA, 20 nt, Artificial sequence
  specific aptamers
ggugagguguggaagcggcg

SEQ ID NO: 6462 - RNA, 20 nt, Artificial sequence
  specific aptamers
ggugagguguggaagcggug

SEQ ID NO: 6463 - RNA, 20 nt, Artificial sequence
  specific aptamers
ggugagguguggaaguggag

SEQ ID NO: 6464 - RNA, 20 nt, Artificial sequence
  specific aptamers
ggugagguguggaaguggcg

SEQ ID NO: 6465 - RNA, 20 nt, Artificial sequence
  specific aptamers
ggugagguguggaaguggug

SEQ ID NO: 6466 - RNA, 20 nt, Artificial sequence
  specific aptamers
ggugagguguggaugaggag

SEQ ID NO: 6467 - RNA, 20 nt, Artificial sequence
  specific aptamers
ggugagguguggaugaggcg

SEQ ID NO: 6468 - RNA, 20 nt, Artificial sequence
  specific aptamers
ggugagguguggaugaggug

SEQ ID NO: 6469 - RNA, 20 nt, Artificial sequence
  specific aptamers
ggugagguguggaugcggag

SEQ ID NO: 6470 - RNA, 20 nt, Artificial sequence
  specific aptamers
ggugagguguggaugcggcg

SEQ ID NO: 6471 - RNA, 20 nt, Artificial sequence
  specific aptamers
ggugagguguggaugcggug

SEQ ID NO: 6472 - RNA, 20 nt, Artificial sequence
  specific aptamers
ggugagguguggauguggag

SEQ ID NO: 6473 - RNA, 20 nt, Artificial sequence
  specific aptamers
ggugagguguggauguggcg

SEQ ID NO: 6474 - RNA, 20 nt, Artificial sequence
  specific aptamers
ggugagguguggauguggug

SEQ ID NO: 6475 - RNA, 19 nt, Artificial sequence
  specific aptamers
ggugagguguggagaggag

SEQ ID NO: 6476 - RNA, 19 nt, Artificial sequence
  specific aptamers
ggugagguguggagaggcg

SEQ ID NO: 6477 - RNA, 19 nt, Artificial sequence
  specific aptamers
ggugagguguggagaggug

SEQ ID NO: 6478 - RNA, 19 nt, Artificial sequence
  specific aptamers
ggugagguguggagcggag

SEQ ID NO: 6479 - RNA, 19 nt, Artificial sequence
  specific aptamers
ggugagguguggagcggcg

SEQ ID NO: 6480 - RNA, 19 nt, Artificial sequence
  specific aptamers
ggugagguguggagcggug

SEQ ID NO: 6481 - RNA, 19 nt, Artificial sequence
  specific aptamers
ggugagguguggaguggag

SEQ ID NO: 6482 - RNA, 19 nt, Artificial sequence
  specific aptamers
ggugagguguggaguggcg

SEQ ID NO: 6483 - RNA, 19 nt, Artificial sequence
  specific aptamers
ggugagguguggaguggug

SEQ ID NO: 6484 - RNA, 20 nt, Artificial sequence
  specific aptamers
ggugaggugugguagaggag

SEQ ID NO: 6485 - RNA, 20 nt, Artificial sequence
  specific aptamers
ggugaggugugguagaggcg

SEQ ID NO: 6486 - RNA, 20 nt, Artificial sequence
  specific aptamers
ggugaggugugguagaggug

SEQ ID NO: 6487 - RNA, 20 nt, Artificial sequence
  specific aptamers
ggugaggugugguagcggag

SEQ ID NO: 6488 - RNA, 20 nt, Artificial sequence
  specific aptamers
ggugaggugugguagcggcg

SEQ ID NO: 6489 - RNA, 20 nt, Artificial sequence
  specific aptamers
ggugaggugugguagcggug

SEQ ID NO: 6490 - RNA, 20 nt, Artificial sequence
  specific aptamers
ggugaggugugguaguggag

SEQ ID NO: 6491 - RNA, 20 nt, Artificial sequence
  specific aptamers
ggugaggugugguaguggcg

SEQ ID NO: 6492 - RNA, 20 nt, Artificial sequence
  specific aptamers
ggugaggugugguaguggug

SEQ ID NO: 6493 - RNA, 20 nt, Artificial sequence
  specific aptamers
ggugaggugugguugaggag

SEQ ID NO: 6494 - RNA, 20 nt, Artificial sequence
  specific aptamers
ggugaggugugguugaggcg

SEQ ID NO: 6495 - RNA, 20 nt, Artificial sequence
  specific aptamers
ggugaggugugguugaggug

SEQ ID NO: 6496 - RNA, 20 nt, Artificial sequence
  specific aptamers
ggugaggugugguugcggag

SEQ ID NO: 6497 - RNA, 20 nt, Artificial sequence
  specific aptamers
ggugaggugugguugcggcg

SEQ ID NO: 6498 - RNA, 20 nt, Artificial sequence
  specific aptamers
ggugaggugugguugcggug

SEQ ID NO: 6499 - RNA, 20 nt, Artificial sequence
  specific aptamers
ggugaggugugguuguggag

SEQ ID NO: 6500 - RNA, 20 nt, Artificial sequence
  specific aptamers
ggugaggugugguuguggcg

SEQ ID NO: 6501 - RNA, 20 nt, Artificial sequence
  specific aptamers
ggugaggugugguuguggug

SEQ ID NO: 6502 - RNA, 19 nt, Artificial sequence
  specific aptamers
ggugagguguggugaggag

SEQ ID NO: 6503 - RNA, 19 nt, Artificial sequence
  specific aptamers
ggugagguguggugaggcg

SEQ ID NO: 6504 - RNA, 19 nt, Artificial sequence
  specific aptamers
ggugagguguggugaggug

SEQ ID NO: 6505 - RNA, 19 nt, Artificial sequence
  specific aptamers
ggugagguguggugcggag

SEQ ID NO: 6506 - RNA, 19 nt, Artificial sequence
  specific aptamers
ggugagguguggugcggcg

SEQ ID NO: 6507 - RNA, 19 nt, Artificial sequence
  specific aptamers
ggugagguguggugcggug

SEQ ID NO: 6508 - RNA, 19 nt, Artificial sequence
  specific aptamers
ggugaggugugguguggag

SEQ ID NO: 6509 - RNA, 19 nt, Artificial sequence
  specific aptamers
ggugaggugugguguggcg

SEQ ID NO: 6510 - RNA, 19 nt, Artificial sequence
  specific aptamers
ggugaggugugguguggug

SEQ ID NO: 6511 - RNA, 20 nt, Artificial sequence
  specific aptamers
gguguggagaggaagaggag

SEQ ID NO: 6512 - RNA, 20 nt, Artificial sequence
  specific aptamers
gguguggagaggaagaggcg

SEQ ID NO: 6513 - RNA, 20 nt, Artificial sequence
  specific aptamers
gguguggagaggaagaggug

SEQ ID NO: 6514 - RNA, 20 nt, Artificial sequence
  specific aptamers
gguguggagaggaagcggag

SEQ ID NO: 6515 - RNA, 20 nt, Artificial sequence
  specific aptamers
gguguggagaggaagcggcg

SEQ ID NO: 6516 - RNA, 20 nt, Artificial sequence
  specific aptamers
gguguggagaggaagcggug

SEQ ID NO: 6517 - RNA, 20 nt, Artificial sequence
  specific aptamers
gguguggagaggaaguggag

SEQ ID NO: 6518 - RNA, 20 nt, Artificial sequence
  specific aptamers
gguguggagaggaaguggcg

SEQ ID NO: 6519 - RNA, 20 nt, Artificial sequence
  specific aptamers
gguguggagaggaaguggug

SEQ ID NO: 6520 - RNA, 20 nt, Artificial sequence
  specific aptamers
gguguggagaggaugaggag

SEQ ID NO: 6521 - RNA, 20 nt, Artificial sequence
  specific aptamers
gguguggagaggaugaggcg

SEQ ID NO: 6522 - RNA, 20 nt, Artificial sequence
  specific aptamers
gguguggagaggaugaggug

SEQ ID NO: 6523 - RNA, 20 nt, Artificial sequence
  specific aptamers
gguguggagaggaugcggag

SEQ ID NO: 6524 - RNA, 20 nt, Artificial sequence
  specific aptamers
gguguggagaggaugcggcg

SEQ ID NO: 6525 - RNA, 20 nt, Artificial sequence
  specific aptamers
gguguggagaggaugcggug

SEQ ID NO: 6526 - RNA, 20 nt, Artificial sequence
  specific aptamers
gguguggagaggauguggag

SEQ ID NO: 6527 - RNA, 20 nt, Artificial sequence
  specific aptamers
gguguggagaggauguggcg

SEQ ID NO: 6528 - RNA, 20 nt, Artificial sequence
  specific aptamers
gguguggagaggauguggug

SEQ ID NO: 6529 - RNA, 19 nt, Artificial sequence
  specific aptamers
gguguggagaggagaggcg

SEQ ID NO: 6530 - RNA, 19 nt, Artificial sequence
  specific aptamers
gguguggagaggagaggug

SEQ ID NO: 6531 - RNA, 19 nt, Artificial sequence
  specific aptamers
gguguggagaggagcggag

SEQ ID NO: 6532 - RNA, 19 nt, Artificial sequence
  specific aptamers
gguguggagaggagcggcg

SEQ ID NO: 6533 - RNA, 19 nt, Artificial sequence
  specific aptamers
gguguggagaggagcggug

SEQ ID NO: 6534 - RNA, 19 nt, Artificial sequence
  specific aptamers
gguguggagaggaguggag

SEQ ID NO: 6535 - RNA, 19 nt, Artificial sequence
  specific aptamers
gguguggagaggaguggcg

SEQ ID NO: 6536 - RNA, 19 nt, Artificial sequence
  specific aptamers
gguguggagaggaguggug

SEQ ID NO: 6537 - RNA, 20 nt, Artificial sequence
  specific aptamers
gguguggagagguagaggag

SEQ ID NO: 6538 - RNA, 20 nt, Artificial sequence
  specific aptamers
gguguggagagguagaggcg

SEQ ID NO: 6539 - RNA, 20 nt, Artificial sequence
  specific aptamers
gguguggagagguagaggug

SEQ ID NO: 6540 - RNA, 20 nt, Artificial sequence
  specific aptamers
gguguggagagguagcggag

SEQ ID NO: 6541 - RNA, 20 nt, Artificial sequence
  specific aptamers
gguguggagagguagcggcg

SEQ ID NO: 6542 - RNA, 20 nt, Artificial sequence
  specific aptamers
gguguggagagguagcggug

SEQ ID NO: 6543 - RNA, 20 nt, Artificial sequence
  specific aptamers
gguguggagagguaguggag

SEQ ID NO: 6544 - RNA, 20 nt, Artificial sequence
  specific aptamers
gguguggagagguaguggcg

SEQ ID NO: 6545 - RNA, 20 nt, Artificial sequence
  specific aptamers
gguguggagagguaguggug

SEQ ID NO: 6546 - RNA, 20 nt, Artificial sequence
  specific aptamers
gguguggagagguugaggag

SEQ ID NO: 6547 - RNA, 20 nt, Artificial sequence
  specific aptamers
gguguggagagguugaggcg

SEQ ID NO: 6548 - RNA, 20 nt, Artificial sequence
  specific aptamers
gguguggagagguugaggug

SEQ ID NO: 6549 - RNA, 20 nt, Artificial sequence
  specific aptamers
gguguggagagguugcggag

SEQ ID NO: 6550 - RNA, 20 nt, Artificial sequence
  specific aptamers
gguguggagagguugcggcg

SEQ ID NO: 6551 - RNA, 20 nt, Artificial sequence
  specific aptamers
gguguggagagguugcggug

SEQ ID NO: 6552 - RNA, 20 nt, Artificial sequence
  specific aptamers
gguguggagagguuguggag

SEQ ID NO: 6553 - RNA, 20 nt, Artificial sequence
  specific aptamers
gguguggagagguuguggcg

SEQ ID NO: 6554 - RNA, 20 nt, Artificial sequence
  specific aptamers
gguguggagagguuguggug

SEQ ID NO: 6555 - RNA, 19 nt, Artificial sequence
  specific aptamers
gguguggagaggugaggag

SEQ ID NO: 6556 - RNA, 19 nt, Artificial sequence
  specific aptamers
gguguggagaggugaggcg

SEQ ID NO: 6557 - RNA, 19 nt, Artificial sequence
  specific aptamers
gguguggagaggugaggug

SEQ ID NO: 6558 - RNA, 19 nt, Artificial sequence
  specific aptamers
gguguggagaggugcggag

SEQ ID NO: 6559 - RNA, 19 nt, Artificial sequence
  specific aptamers
gguguggagaggugcggcg

SEQ ID NO: 6560 - RNA, 19 nt, Artificial sequence
  specific aptamers
gguguggagaggugcggug

SEQ ID NO: 6561 - RNA, 19 nt, Artificial sequence
  specific aptamers
gguguggagagguguggag

SEQ ID NO: 6562 - RNA, 19 nt, Artificial sequence
  specific aptamers
gguguggagagguguggcg

SEQ ID NO: 6563 - RNA, 19 nt, Artificial sequence
  specific aptamers
gguguggagagguguggug

SEQ ID NO: 6564 - RNA, 20 nt, Artificial sequence
  specific aptamers
gguguggaguggaagaggag

SEQ ID NO: 6565 - RNA, 20 nt, Artificial sequence
  specific aptamers
gguguggaguggaagaggcg

SEQ ID NO: 6566 - RNA, 20 nt, Artificial sequence
  specific aptamers
gguguggaguggaagaggug

SEQ ID NO: 6567 - RNA, 20 nt, Artificial sequence
  specific aptamers
gguguggaguggaagcggag

SEQ ID NO: 6568 - RNA, 20 nt, Artificial sequence
  specific aptamers
gguguggaguggaagcggcg

SEQ ID NO: 6569 - RNA, 20 nt, Artificial sequence
  specific aptamers
gguguggaguggaagcggug

SEQ ID NO: 6570 - RNA, 20 nt, Artificial sequence
  specific aptamers
gguguggaguggaaguggag

SEQ ID NO: 6571 - RNA, 20 nt, Artificial sequence
  specific aptamers
gguguggaguggaaguggcg

SEQ ID NO: 6572 - RNA, 20 nt, Artificial sequence
  specific aptamers
gguguggaguggaaguggug

SEQ ID NO: 6573 - RNA, 20 nt, Artificial sequence
  specific aptamers
gguguggaguggaugaggag

SEQ ID NO: 6574 - RNA, 20 nt, Artificial sequence
  specific aptamers
gguguggaguggaugaggcg

SEQ ID NO: 6575 - RNA, 20 nt, Artificial sequence
  specific aptamers
gguguggaguggaugaggug

SEQ ID NO: 6576 - RNA, 20 nt, Artificial sequence
  specific aptamers
gguguggaguggaugcggag

SEQ ID NO: 6577 - RNA, 20 nt, Artificial sequence
  specific aptamers
gguguggaguggaugcggcg

SEQ ID NO: 6578 - RNA, 20 nt, Artificial sequence
  specific aptamers
gguguggaguggaugcggug

SEQ ID NO: 6579 - RNA, 20 nt, Artificial sequence
  specific aptamers
gguguggaguggauguggag

SEQ ID NO: 6580 - RNA, 20 nt, Artificial sequence
  specific aptamers
gguguggaguggauguggcg

SEQ ID NO: 6581 - RNA, 20 nt, Artificial sequence
  specific aptamers
gguguggaguggauguggug

SEQ ID NO: 6582 - RNA, 19 nt, Artificial sequence
  specific aptamers
gguguggaguggagaggag

SEQ ID NO: 6583 - RNA, 19 nt, Artificial sequence
  specific aptamers
gguguggaguggagaggcg

SEQ ID NO: 6584 - RNA, 19 nt, Artificial sequence
  specific aptamers
gguguggaguggagaggug

SEQ ID NO: 6585 - RNA, 19 nt, Artificial sequence
  specific aptamers
gguguggaguggagcggag

SEQ ID NO: 6586 - RNA, 19 nt, Artificial sequence
  specific aptamers
gguguggaguggagcggcg

SEQ ID NO: 6587 - RNA, 19 nt, Artificial sequence
  specific aptamers
gguguggaguggagcggug

SEQ ID NO: 6588 - RNA, 19 nt, Artificial sequence
  specific aptamers
gguguggaguggaguggag

SEQ ID NO: 6589 - RNA, 19 nt, Artificial sequence
  specific aptamers
gguguggaguggaguggcg

SEQ ID NO: 6590 - RNA, 19 nt, Artificial sequence
  specific aptamers
gguguggaguggaguggug

SEQ ID NO: 6591 - RNA, 20 nt, Artificial sequence
  specific aptamers
gguguggagugguagaggag

SEQ ID NO: 6592 - RNA, 20 nt, Artificial sequence
  specific aptamers
gguguggagugguagaggcg

SEQ ID NO: 6593 - RNA, 20 nt, Artificial sequence
  specific aptamers
gguguggagugguagaggug

SEQ ID NO: 6594 - RNA, 20 nt, Artificial sequence
  specific aptamers
gguguggagugguagcggag

SEQ ID NO: 6595 - RNA, 20 nt, Artificial sequence
  specific aptamers
gguguggagugguagcggcg

SEQ ID NO: 6596 - RNA, 20 nt, Artificial sequence
  specific aptamers
gguguggagugguagcggug

SEQ ID NO: 6597 - RNA, 20 nt, Artificial sequence
  specific aptamers
gguguggagugguaguggag

SEQ ID NO: 6598 - RNA, 20 nt, Artificial sequence
  specific aptamers
gguguggagugguaguggcg

SEQ ID NO: 6599 - RNA, 20 nt, Artificial sequence
  specific aptamers
gguguggagugguaguggug

SEQ ID NO: 6600 - RNA, 20 nt, Artificial sequence
  specific aptamers
gguguggagugguugaggag

SEQ ID NO: 6601 - RNA, 20 nt, Artificial sequence
  specific aptamers
gguguggagugguugaggcg

SEQ ID NO: 6602 - RNA, 20 nt, Artificial sequence
  specific aptamers
gguguggagugguugaggug

SEQ ID NO: 6603 - RNA, 20 nt, Artificial sequence
  specific aptamers
gguguggagugguugcggag

SEQ ID NO: 6604 - RNA, 20 nt, Artificial sequence
  specific aptamers
gguguggagugguugcggcg

SEQ ID NO: 6605 - RNA, 20 nt, Artificial sequence
  specific aptamers
gguguggagugguugcggug

SEQ ID NO: 6606 - RNA, 20 nt, Artificial sequence
  specific aptamers
gguguggagugguuguggag

SEQ ID NO: 6607 - RNA, 20 nt, Artificial sequence
  specific aptamers
gguguggagugguuguggcg

SEQ ID NO: 6608 - RNA, 20 nt, Artificial sequence
  specific aptamers
gguguggagugguuguggug

SEQ ID NO: 6609 - RNA, 19 nt, Artificial sequence
  specific aptamers
gguguggaguggugaggag

SEQ ID NO: 6610 - RNA, 19 nt, Artificial sequence
  specific aptamers
gguguggaguggugaggcg

SEQ ID NO: 6611 - RNA, 19 nt, Artificial sequence
  specific aptamers
gguguggaguggugaggug

SEQ ID NO: 6612 - RNA, 19 nt, Artificial sequence
  specific aptamers
gguguggaguggugcggag

SEQ ID NO: 6613 - RNA, 19 nt, Artificial sequence
  specific aptamers
gguguggaguggugcggcg

SEQ ID NO: 6614 - RNA, 19 nt, Artificial sequence
  specific aptamers
gguguggaguggugcggug

SEQ ID NO: 6615 - RNA, 19 nt, Artificial sequence
  specific aptamers
gguguggagugguguggag

SEQ ID NO: 6616 - RNA, 19 nt, Artificial sequence
  specific aptamers
gguguggagugguguggcg

SEQ ID NO: 6617 - RNA, 19 nt, Artificial sequence
  specific aptamers
gguguggagugguguggug

SEQ ID NO: 6618 - RNA, 20 nt, Artificial sequence
  specific aptamers
gguguggugaggaagaggag

SEQ ID NO: 6619 - RNA, 20 nt, Artificial sequence
  specific aptamers
gguguggugaggaagaggcg

SEQ ID NO: 6620 - RNA, 20 nt, Artificial sequence
  specific aptamers
gguguggugaggaagaggug

SEQ ID NO: 6621 - RNA, 20 nt, Artificial sequence
  specific aptamers
gguguggugaggaagcggag

SEQ ID NO: 6622 - RNA, 20 nt, Artificial sequence
  specific aptamers
gguguggugaggaagcggcg

SEQ ID NO: 6623 - RNA, 20 nt, Artificial sequence
  specific aptamers
gguguggugaggaagcggug

SEQ ID NO: 6624 - RNA, 20 nt, Artificial sequence
  specific aptamers
gguguggugaggaaguggag

SEQ ID NO: 6625 - RNA, 20 nt, Artificial sequence
  specific aptamers
gguguggugaggaaguggcg

SEQ ID NO: 6626 - RNA, 20 nt, Artificial sequence
  specific aptamers
gguguggugaggaaguggug

SEQ ID NO: 6627 - RNA, 20 nt, Artificial sequence
  specific aptamers
gguguggugaggaugaggag

SEQ ID NO: 6628 - RNA, 20 nt, Artificial sequence
  specific aptamers
gguguggugaggaugaggcg

SEQ ID NO: 6629 - RNA, 20 nt, Artificial sequence
  specific aptamers
gguguggugaggaugaggug

SEQ ID NO: 6630 - RNA, 20 nt, Artificial sequence
  specific aptamers
gguguggugaggaugcggag

SEQ ID NO: 6631 - RNA, 20 nt, Artificial sequence
  specific aptamers
gguguggugaggaugcggcg

SEQ ID NO: 6632 - RNA, 20 nt, Artificial sequence
  specific aptamers
gguguggugaggaugcggug

SEQ ID NO: 6633 - RNA, 20 nt, Artificial sequence
  specific aptamers
gguguggugaggauguggag

SEQ ID NO: 6634 - RNA, 20 nt, Artificial sequence
  specific aptamers
gguguggugaggauguggcg

SEQ ID NO: 6635 - RNA, 20 nt, Artificial sequence
  specific aptamers
gguguggugaggauguggug

SEQ ID NO: 6636 - RNA, 19 nt, Artificial sequence
  specific aptamers
gguguggugaggagaggag

SEQ ID NO: 6637 - RNA, 19 nt, Artificial sequence
  specific aptamers
gguguggugaggagaggcg

SEQ ID NO: 6638 - RNA, 19 nt, Artificial sequence
  specific aptamers
gguguggugaggagaggug

SEQ ID NO: 6639 - RNA, 19 nt, Artificial sequence
  specific aptamers
gguguggugaggagcggag

SEQ ID NO: 6640 - RNA, 19 nt, Artificial sequence
  specific aptamers
gguguggugaggagcggcg

SEQ ID NO: 6641 - RNA, 19 nt, Artificial sequence
  specific aptamers
gguguggugaggagcggug

SEQ ID NO: 6642 - RNA, 19 nt, Artificial sequence
  specific aptamers
gguguggugaggaguggag

SEQ ID NO: 6643 - RNA, 19 nt, Artificial sequence
  specific aptamers
gguguggugaggaguggcg

SEQ ID NO: 6644 - RNA, 19 nt, Artificial sequence
  specific aptamers
gguguggugaggaguggug

SEQ ID NO: 6645 - RNA, 20 nt, Artificial sequence
  specific aptamers
gguguggugagguagaggag

SEQ ID NO: 6646 - RNA, 20 nt, Artificial sequence
  specific aptamers
gguguggugagguagaggcg

SEQ ID NO: 6647 - RNA, 20 nt, Artificial sequence
  specific aptamers
gguguggugagguagaggug

SEQ ID NO: 6648 - RNA, 20 nt, Artificial sequence
  specific aptamers
gguguggugagguagcggag

SEQ ID NO: 6649 - RNA, 20 nt, Artificial sequence
  specific aptamers
gguguggugagguagcggcg

SEQ ID NO: 6650 - RNA, 20 nt, Artificial sequence
  specific aptamers
gguguggugagguagcggug

SEQ ID NO: 6651 - RNA, 20 nt, Artificial sequence
  specific aptamers
gguguggugagguaguggag

SEQ ID NO: 6652 - RNA, 20 nt, Artificial sequence
  specific aptamers
gguguggugagguaguggcg

SEQ ID NO: 6653 - RNA, 20 nt, Artificial sequence
  specific aptamers
gguguggugagguaguggug

SEQ ID NO: 6654 - RNA, 20 nt, Artificial sequence
  specific aptamers
gguguggugagguugaggag

SEQ ID NO: 6655 - RNA, 20 nt, Artificial sequence
  specific aptamers
gguguggugagguugaggcg

SEQ ID NO: 6656 - RNA, 20 nt, Artificial sequence
  specific aptamers
gguguggugagguugaggug

SEQ ID NO: 6657 - RNA, 20 nt, Artificial sequence
  specific aptamers
gguguggugagguugcggag

SEQ ID NO: 6658 - RNA, 20 nt, Artificial sequence
  specific aptamers
gguguggugagguugcggcg

SEQ ID NO: 6659 - RNA, 20 nt, Artificial sequence
  specific aptamers
gguguggugagguugcggug

SEQ ID NO: 6660 - RNA, 20 nt, Artificial sequence
  specific aptamers
gguguggugagguuguggag

SEQ ID NO: 6661 - RNA, 20 nt, Artificial sequence
  specific aptamers
gguguggugagguuguggcg

SEQ ID NO: 6662 - RNA, 20 nt, Artificial sequence
  specific aptamers
gguguggugagguuguggug

SEQ ID NO: 6663 - RNA, 19 nt, Artificial sequence
  specific aptamers
gguguggugaggugaggag

SEQ ID NO: 6664 - RNA, 19 nt, Artificial sequence
  specific aptamers
gguguggugaggugaggcg

SEQ ID NO: 6665 - RNA, 19 nt, Artificial sequence
  specific aptamers
gguguggugaggugaggug

SEQ ID NO: 6666 - RNA, 19 nt, Artificial sequence
  specific aptamers
gguguggugaggugcggag

SEQ ID NO: 6667 - RNA, 19 nt, Artificial sequence
  specific aptamers
gguguggugaggugcggcg

SEQ ID NO: 6668 - RNA, 19 nt, Artificial sequence
  specific aptamers
gguguggugaggugcggug

SEQ ID NO: 6669 - RNA, 19 nt, Artificial sequence
  specific aptamers
gguguggugagguguggag

SEQ ID NO: 6670 - RNA, 19 nt, Artificial sequence
  specific aptamers
gguguggugagguguggcg

SEQ ID NO: 6671 - RNA, 19 nt, Artificial sequence
  specific aptamers
gguguggugagguguggug

SEQ ID NO: 6672 - RNA, 20 nt, Artificial sequence
  specific aptamers
ggugugguguggaagaggag

SEQ ID NO: 6673 - RNA, 20 nt, Artificial sequence
  specific aptamers
ggugugguguggaagaggcg

SEQ ID NO: 6674 - RNA, 20 nt, Artificial sequence
  specific aptamers
ggugugguguggaagaggug

SEQ ID NO: 6675 - RNA, 20 nt, Artificial sequence
  specific aptamers
ggugugguguggaagcggag

SEQ ID NO: 6676 - RNA, 20 nt, Artificial sequence
  specific aptamers
ggugugguguggaagcggcg

SEQ ID NO: 6677 - RNA, 20 nt, Artificial sequence
  specific aptamers
ggugugguguggaagcggug

SEQ ID NO: 6678 - RNA, 20 nt, Artificial sequence
  specific aptamers
ggugugguguggaaguggag

SEQ ID NO: 6679 - RNA, 20 nt, Artificial sequence
  specific aptamers
ggugugguguggaaguggcg

SEQ ID NO: 6680 - RNA, 20 nt, Artificial sequence
  specific aptamers
ggugugguguggaaguggug

SEQ ID NO: 6681 - RNA, 20 nt, Artificial sequence
  specific aptamers
ggugugguguggaugaggag

SEQ ID NO: 6682 - RNA, 20 nt, Artificial sequence
  specific aptamers
ggugugguguggaugaggcg

SEQ ID NO: 6683 - RNA, 20 nt, Artificial sequence
  specific aptamers
ggugugguguggaugaggug

SEQ ID NO: 6684 - RNA, 20 nt, Artificial sequence
  specific aptamers
ggugugguguggaugcggag

SEQ ID NO: 6685 - RNA, 20 nt, Artificial sequence
  specific aptamers
ggugugguguggaugcggcg

SEQ ID NO: 6686 - RNA, 20 nt, Artificial sequence
  specific aptamers
ggugugguguggaugcggug

SEQ ID NO: 6687 - RNA, 20 nt, Artificial sequence
  specific aptamers
ggugugguguggauguggag

SEQ ID NO: 6688 - RNA, 20 nt, Artificial sequence
  specific aptamers
ggugugguguggauguggcg

SEQ ID NO: 6689 - RNA, 20 nt, Artificial sequence
  specific aptamers
ggugugguguggauguggug

SEQ ID NO: 6690 - RNA, 19 nt, Artificial sequence
  specific aptamers
ggugugguguggagaggag

SEQ ID NO: 6691 - RNA, 19 nt, Artificial sequence
  specific aptamers
ggugugguguggagaggcg

SEQ ID NO: 6692 - RNA, 19 nt, Artificial sequence
  specific aptamers
ggugugguguggagaggug

SEQ ID NO: 6693 - RNA, 19 nt, Artificial sequence
  specific aptamers
ggugugguguggagcggag

SEQ ID NO: 6694 - RNA, 19 nt, Artificial sequence
  specific aptamers
ggugugguguggagcggcg

SEQ ID NO: 6695 - RNA, 19 nt, Artificial sequence
  specific aptamers
ggugugguguggagcggug

SEQ ID NO: 6696 - RNA, 19 nt, Artificial sequence
  specific aptamers
ggugugguguggaguggag

SEQ ID NO: 6697 - RNA, 19 nt, Artificial sequence
  specific aptamers
ggugugguguggaguggcg

SEQ ID NO: 6698 - RNA, 19 nt, Artificial sequence
  specific aptamers
ggugugguguggaguggug

SEQ ID NO: 6699 - RNA, 20 nt, Artificial sequence
  specific aptamers
gguguggugugguagaggag

SEQ ID NO: 6700 - RNA, 20 nt, Artificial sequence
  specific aptamers
gguguggugugguagaggcg

SEQ ID NO: 6701 - RNA, 20 nt, Artificial sequence
  specific aptamers
gguguggugugguagaggug

SEQ ID NO: 6702 - RNA, 20 nt, Artificial sequence
  specific aptamers
gguguggugugguagcggag

SEQ ID NO: 6703 - RNA, 20 nt, Artificial sequence
  specific aptamers
gguguggugugguagcggcg

SEQ ID NO: 6704 - RNA, 20 nt, Artificial sequence
  specific aptamers
gguguggugugguagcggug

SEQ ID NO: 6705 - RNA, 20 nt, Artificial sequence
  specific aptamers
gguguggugugguaguggag

SEQ ID NO: 6706 - RNA, 20 nt, Artificial sequence
  specific aptamers
gguguggugugguaguggcg

SEQ ID NO: 6707 - RNA, 20 nt, Artificial sequence
  specific aptamers
gguguggugugguaguggug

SEQ ID NO: 6708 - RNA, 20 nt, Artificial sequence
  specific aptamers
gguguggugugguugaggag

SEQ ID NO: 6709 - RNA, 20 nt, Artificial sequence
  specific aptamers
gguguggugugguugaggcg

SEQ ID NO: 6710 - RNA, 20 nt, Artificial sequence
  specific aptamers
gguguggugugguugaggug

SEQ ID NO: 6711 - RNA, 20 nt, Artificial sequence
  specific aptamers
gguguggugugguugcggag

SEQ ID NO: 6712 - RNA, 20 nt, Artificial sequence
  specific aptamers
gguguggugugguugcggcg

SEQ ID NO: 6713 - RNA, 20 nt, Artificial sequence
  specific aptamers
gguguggugugguugcggug

SEQ ID NO: 6714 - RNA, 20 nt, Artificial sequence
  specific aptamers
gguguggugugguuguggag

SEQ ID NO: 6715 - RNA, 20 nt, Artificial sequence
  specific aptamers
gguguggugugguuguggcg

SEQ ID NO: 6716 - RNA, 20 nt, Artificial sequence
  specific aptamers
gguguggugugguuguggug

SEQ ID NO: 6717 - RNA, 19 nt, Artificial sequence
  specific aptamers
ggugugguguggugaggag

SEQ ID NO: 6718 - RNA, 19 nt, Artificial sequence
  specific aptamers
ggugugguguggugaggcg

SEQ ID NO: 6719 - RNA, 19 nt, Artificial sequence
  specific aptamers
ggugugguguggugaggug

SEQ ID NO: 6720 - RNA, 19 nt, Artificial sequence
  specific aptamers
ggugugguguggugcggag

SEQ ID NO: 6721 - RNA, 19 nt, Artificial sequence
  specific aptamers
ggugugguguggugcggcg

SEQ ID NO: 6722 - RNA, 19 nt, Artificial sequence
  specific aptamers
ggugugguguggugcggug

SEQ ID NO: 6723 - RNA, 19 nt, Artificial sequence
  specific aptamers
gguguggugugguguggag

SEQ ID NO: 6724 - RNA, 19 nt, Artificial sequence
  specific aptamers
gguguggugugguguggcg

SEQ ID NO: 6725 - RNA, 19 nt, Artificial sequence
  specific aptamers
gguguggugugguguggug

SEQ ID NO: 6726 - RNA, 45 nt, Artificial sequence
  specific aptamers
ggcacguacgaaggaagguuugguaugugguauauucguacgugc

SEQ ID NO: 6727 - RNA, 45 nt, Artificial sequence
  specific aptamers
ggcacguacgaaggaaggauugguaugugguauauucguacgugc

SEQ ID NO: 6728 - RNA, 45 nt, Artificial sequence
  specific aptamers
ggcacguacgaaggaagguuugguaagugguauauucguacgugc

SEQ ID NO: 6729 - RNA, 23 nt, Artificial sequence
  specific aptamers
ggaagguuugguaagugguauau

SEQ ID NO: 6730 - RNA, 45 nt, Artificial sequence
  specific aptamers
ggcacguacgaaggaaggauugguaagugguauauucguacgugc

SEQ ID NO: 6731 - RNA, 23 nt, Artificial sequence
  specific aptamers
ggaaggauugguaagugguauau

SEQ ID NO: 6732 - RNA, 45 nt, Artificial sequence
  specific aptamers
ggcacguacgaaggaaggauugguacgugguauauucguacgugc

SEQ ID NO: 6733 - RNA, 23 nt, Artificial sequence
  specific aptamers
ggaaggauugguacgugguauau

SEQ ID NO: 6734 - RNA, 45 nt, Artificial sequence
  specific aptamers
ggcacguacgaaggaaggguugguaugugguauauucguacgugc

SEQ ID NO: 6735 - RNA, 23 nt, Artificial sequence
  specific aptamers
ggaaggguugguaugugguauau

SEQ ID NO: 6736 - RNA, 45 nt, Artificial sequence
  specific aptamers
ggcacguacgaaggaagguuugguaggugguauauucguacgugc

SEQ ID NO: 6737 - RNA, 23 nt, Artificial sequence
  specific aptamers
ggaagguuugguaggugguauau

SEQ ID NO: 6738 - RNA, 45 nt, Artificial sequence
  specific aptamers
ggcacguacgaaggaaggauugguaggugguauauucguacgugc

SEQ ID NO: 6739 - RNA, 23 nt, Artificial sequence
  specific aptamers
ggaaggauugguaggugguauau

SEQ ID NO: 6740 - RNA, 45 nt, Artificial sequence
  specific aptamers
ggcacguacgaaggaaggcuugguacgugguauauucguacgugc

SEQ ID NO: 6741 - RNA, 23 nt, Artificial sequence
  specific aptamers
ggaaggcuugguacgugguauau

SEQ ID NO: 6742 - RNA, 45 nt, Artificial sequence
  specific aptamers
ggcacguacgaaggaaggguugguaggugguauauucguacgugc

SEQ ID NO: 6743 - RNA, 23 nt, Artificial sequence
  specific aptamers
ggaaggguugguaggugguauau

SEQ ID NO: 6744 - RNA, 45 nt, Artificial sequence
  specific aptamers
ggcacguacgaaggaaggguugguaagugguauauucguacgugc

SEQ ID NO: 6745 - RNA, 23 nt, Artificial sequence
  specific aptamers
ggaaggguugguaagugguauau

SEQ ID NO: 6746 - RNA, 45 nt, Artificial sequence
  specific aptamers
ggcacguacgaaggaaggguugguacgugguauauucguacgugc

SEQ ID NO: 6747 - RNA, 23 nt, Artificial sequence
  specific aptamers
ggaaggguugguacgugguauau

SEQ ID NO: 6748 - RNA, 45 nt, Artificial sequence
  specific aptamers
ggcacguacgaaggaaggcuugguaugugguauauucguacgugc

SEQ ID NO: 6749 - RNA, 23 nt, Artificial sequence
  specific aptamers
ggaaggcuugguaugugguauau

SEQ ID NO: 6750 - RNA, 45 nt, Artificial sequence
  specific aptamers
ggcacguacgaaggaagguuugguacgugguauauucguacgugc

SEQ ID NO: 6751 - RNA, 23 nt, Artificial sequence
  specific aptamers
ggaagguuugguacgugguauau

SEQ ID NO: 6752 - RNA, 45 nt, Artificial sequence
  specific aptamers
ggcacguacgaaggaaggcuugguaagugguauauucguacgugc

SEQ ID NO: 6753 - RNA, 23 nt, Artificial sequence
  specific aptamers
ggaaggcuugguaagugguauau

SEQ ID NO: 6754 - RNA, 45 nt, Artificial sequence
  specific aptamers
ggcacguacgaaggaaggcuugguaggugguauauucguacgugc

SEQ ID NO: 6755 - RNA, 23 nt, Artificial sequence
  specific aptamers
ggaaggcuugguaggugguauau

SEQ ID NO: 6756 - RNA, 53 nt, Artificial sequence
  specific aptamers
ggaagaaugaaggaagguuugguaugggguaguugucauucuucccauguuug

SEQ ID NO: 6757 - RNA, 53 nt, Artificial sequence
  specific aptamers
ggaagaaugaaggacgguuugguaugugguaguggucauucuucccauguuug

SEQ ID NO: 6758 - RNA, 45 nt, Artificial sequence
  specific aptamers
ggcacguacgaaggaaggauugguaugugguacauucguacgugc

SEQ ID NO: 6759 - RNA, 45 nt, Artificial sequence
  specific aptamers
ggcacguacgaaggaaggauugguauguggcauauucguacgugc

SEQ ID NO: 6760 - RNA, 23 nt, Artificial sequence
  specific aptamers
ggaaggauugguauguggcauau

SEQ ID NO: 6761 - RNA, 45 nt, Artificial sequence
  specific aptamers
ggcacguacgaaggaaggauuggcaugugguauauucguacgugc

SEQ ID NO: 6762 - RNA, 44 nt, Artificial sequence
  specific aptamers
ggcacguacgaaggaaggaugguaugugguauauucguacgugc

SEQ ID NO: 6763 - RNA, 23 nt, Artificial sequence
  specific aptamers
ggaaggaugguaugugguauauu

SEQ ID NO: 6764 - RNA, 45 nt, Artificial sequence
  specific aptamers
ggcacguacgaaggaaggaucgguaugugguauauucguacgugc

SEQ ID NO: 6765 - RNA, 23 nt, Artificial sequence
  specific aptamers
aggaaggaucgguaugugguaua

SEQ ID NO: 6766 - RNA, 45 nt, Artificial sequence
  specific aptamers
ggcacguacgaaggaaggauagguaugugguauauucguacgugc

SEQ ID NO: 6767 - RNA, 23 nt, Artificial sequence
  specific aptamers
ggaaggauagguaugugguauau

SEQ ID NO: 6768 - RNA, 45 nt, Artificial sequence
  specific aptamers
ggcacguaccuaggaaggauugguaugugguauauagguacgugc

SEQ ID NO: 6769 - RNA, 45 nt, Artificial sequence
  specific aptamers
ggcacguacgagggaaggauugguaugugguauacucguacgugc

SEQ ID NO: 6770 - RNA, 23 nt, Artificial sequence
  specific aptamers
ggaaggauugguaugugguauac

SEQ ID NO: 6771 - RNA, 45 nt, Artificial sequence
  specific aptamers
ggcacguacgacggaaggauugguaugugguauagucguacgugc

SEQ ID NO: 6772 - RNA, 23 nt, Artificial sequence
  specific aptamers
ggaaggauugguaugugguauag

SEQ ID NO: 6773 - RNA, 45 nt, Artificial sequence
  specific aptamers
ggcacguacgauggaaggauugguaugugguauaaucguacgugc

SEQ ID NO: 6774 - RNA, 45 nt, Artificial sequence
  specific aptamers
ggcacguacgaaggaaggauugguaugugguauaaucguacgugc

SEQ ID NO: 6775 - RNA, 45 nt, Artificial sequence
  specific aptamers
ggcacguacgaaggaaggauuggaaugugguauauucguacgugc

SEQ ID NO: 6776 - RNA, 45 nt, Artificial sequence
  specific aptamers
ggcacguacgaaggaaggauugguauguggaauauucguacgugc

SEQ ID NO: 6777 - RNA, 23 nt, Artificial sequence
  specific aptamers
ggaaggauugguauguggaauau

SEQ ID NO: 6778 - RNA, 45 nt, Artificial sequence
  specific aptamers
ggcacguacgaaggaaggauuggaauguggaauauucguacgugc

SEQ ID NO: 6779 - RNA, 23 nt, Artificial sequence
  specific aptamers
ggaaggauuggaauguggaauau

SEQ ID NO: 6780 - RNA, 45 nt, Artificial sequence
  specific aptamers
ggcacguacgaaggaaggauugguaugugguaaauucguacgugc

SEQ ID NO: 6781 - RNA, 45 nt, Artificial sequence
  specific aptamers
ggcacguacgaaggaaggauugguaugugauauauucguacgugc

SEQ ID NO: 6782 - RNA, 23 nt, Artificial sequence
  specific aptamers
ggaaggauugguaugugauauau

SEQ ID NO: 6783 - RNA, 43 nt, Artificial sequence
  specific aptamers
ggcacguacgaaggaaggauugguauguguuauucguacgugc

SEQ ID NO: 6784 - RNA, 23 nt, Artificial sequence
  specific aptamers
ggaaggauugguauguguuauuc

SEQ ID NO: 6785 - RNA, 44 nt, Artificial sequence
  specific aptamers
ggcacguacgaaggaggauugguaugugguauauucguacgugc

SEQ ID NO: 6786 - RNA, 23 nt, Artificial sequence
  specific aptamers
ggaggauugguaugugguauauu

SEQ ID NO: 6787 - RNA, 45 nt, Artificial sequence
  specific aptamers
ggcacguacgaaggaaggauugguuugugguauauucguacgugc

SEQ ID NO: 6788 - RNA, 23 nt, Artificial sequence
  specific aptamers
ggaaggauugguuugugguauau

SEQ ID NO: 6789 - RNA, 45 nt, Artificial sequence
  specific aptamers
ggcacguacgaaggaaggauugguaugugguuuauucguacgugc

SEQ ID NO: 6790 - RNA, 23 nt, Artificial sequence
  specific aptamers
ggaaggauugguaugugguuuau

SEQ ID NO: 6791 - RNA, 45 nt, Artificial sequence
  specific aptamers
ggcacguacgaaggaaggauugguuuguguuuuauucguacgugc

SEQ ID NO: 6792 - RNA, 23 nt, Artificial sequence
  specific aptamers
ggaaggauugguuuguguuuuau

SEQ ID NO: 6793 - RNA, 45 nt, Artificial sequence
  specific aptamers
ggcacguacgaaggaaggauugguuugugguuuauucguacgugc

SEQ ID NO: 6794 - RNA, 23 nt, Artificial sequence
  specific aptamers
ggaaggauugguuugugguuuau

SEQ ID NO: 6795 - RNA, 22 nt, Artificial sequence
  specific aptamers
ggaugguuugguaugagguagg

SEQ ID NO: 6796 - RNA, 22 nt, Artificial sequence
  specific aptamers
ggaaggcuugguaagugguaua

SEQ ID NO: 6797 - RNA, 23 nt, Artificial sequence
  specific aptamers
ggaggguuggguaaguguuaaug

SEQ ID NO: 6798 - RNA, 23 nt, Artificial sequence
  specific aptamers
ggacgguuugguaugggguagug

SEQ ID NO: 6799 - RNA, 23 nt, Artificial sequence
  specific aptamers
ggaggguuugguaugagguaguu

SEQ ID NO: 6800 - RNA, 23 nt, Artificial sequence
  specific aptamers
ggacgguuugguaugagguagug

SEQ ID NO: 6801 - RNA, 23 nt, Artificial sequence
  specific aptamers
ggaagguuagguaagggauagag

SEQ ID NO: 6802 - RNA, 22 nt, Artificial sequence
  specific aptamers
ggaugguuugguaugugguaga

SEQ ID NO: 6803 - RNA, 23 nt, Artificial sequence
  specific aptamers
ggaugguuugguaugagguaggu

SEQ ID NO: 6804 - RNA, 23 nt, Artificial sequence
  specific aptamers
ggaggguuugguaugagguaugc

SEQ ID NO: 6805 - RNA, 22 nt, Artificial sequence
  specific aptamers
ggaagguuugguaugagguagg

SEQ ID NO: 6806 - RNA, 22 nt, Artificial sequence
  specific aptamers
ggaagguuugguaugagguaga

SEQ ID NO: 6807 - RNA, 24 nt, Artificial sequence
  specific aptamers
cgaaggagaggagaggaagaggag

SEQ ID NO: 6808 - RNA, 24 nt, Artificial sequence
  specific aptamers
cgcaggagaggagaggaagaggag

SEQ ID NO: 6809 - RNA, 24 nt, Artificial sequence
  specific aptamers
cggaggagaggagaggaagaggag

SEQ ID NO: 6810 - RNA, 24 nt, Artificial sequence
  specific aptamers
cguaggagaggagaggaagaggag

SEQ ID NO: 6811 - RNA, 24 nt, Artificial sequence
  specific aptamers
cgagggagaggagaggaagaggag

SEQ ID NO: 6812 - RNA, 24 nt, Artificial sequence
  specific aptamers
cgcgggagaggagaggaagaggag

SEQ ID NO: 6813 - RNA, 24 nt, Artificial sequence
  specific aptamers
cgggggagaggagaggaagaggag

SEQ ID NO: 6814 - RNA, 24 nt, Artificial sequence
  specific aptamers
cgugggagaggagaggaagaggag

SEQ ID NO: 6815 - RNA, 29 nt, Artificial sequence
  specific aptamers
accgagggaguggugaggaugaggcgagu

SEQ ID NO: 6816 - RNA, 37 nt, Artificial sequence
  specific aptamers
gcguagcgagggaguggugaggaugaggcgacuacgc

SEQ ID NO: 6817 - RNA, 36 nt, Artificial sequence
  specific aptamers
gcguagcgagggaguggugaggaugaggcgcuacgc

SEQ ID NO: 6818 - RNA, 27 nt, Artificial sequence
  specific aptamers
agggaagguuugguaugggguaguuau

SEQ ID NO: 6819 - RNA, 27 nt, Artificial sequence
  specific aptamers
aaggaagguuugguaugggguaguugu

SEQ ID NO: 6820 - RNA, 27 nt, Artificial sequence
  specific aptamers
agggaagguuugguaugggguaguugu

SEQ ID NO: 6821 - RNA, 27 nt, Artificial sequence
  specific aptamers
agggaagguuugguaugggguaguuuu

SEQ ID NO: 6822 - RNA, 27 nt, Artificial sequence
  specific aptamers
auggaagguuugguaugggguaguugu

SEQ ID NO: 6823 - RNA, 27 nt, Artificial sequence
  specific aptamers
aaggaagguuugguaugggguaguuau

SEQ ID NO: 6824 - RNA, 27 nt, Artificial sequence
  specific aptamers
acggaagguuugguaugggguaguuau

SEQ ID NO: 6825 - RNA, 27 nt, Artificial sequence
  specific aptamers
acggaagguuugguaugggguaguuuu

SEQ ID NO: 6826 - RNA, 27 nt, Artificial sequence
  specific aptamers
acggaagguuugguaugggguaguugu

SEQ ID NO: 6827 - RNA, 27 nt, Artificial sequence
  specific aptamers
agggaagguuugguaugggguaguucu

SEQ ID NO: 6828 - RNA, 27 nt, Artificial sequence
  specific aptamers
aaggaagguuugguaugggguaguuuu

SEQ ID NO: 6829 - RNA, 27 nt, Artificial sequence
  specific aptamers
auggaagguuugguaugggguaguuau

SEQ ID NO: 6830 - RNA, 45 nt, Artificial sequence; identical to SEQ ID NO: 6727
  Mango III aptamer

SEQ ID NO: 6831 - RNA, 45 nt, Artificial sequence; identical to SEQ ID NO: 6732
  Mango III aptamer

SEQ ID NO: 6832 - RNA, 45 nt, Artificial sequence; identical to SEQ ID NO: 6738
  Mango III aptamer

SEQ ID NO: 6833 - RNA, 45 nt, Artificial sequence; identical to SEQ ID NO: 6730
  Mango III aptamer

SEQ ID NO: 6834 - RNA, 45 nt, Artificial sequence; identical to SEQ ID NO: 6748
  Mango III aptamer

SEQ ID NO: 6835 - RNA, 45 nt, Artificial sequence; identical to SEQ ID NO: 6740
  Mango III aptamer

SEQ ID NO: 6836 - RNA, 45 nt, Artificial sequence; identical to SEQ ID NO: 6754
  Mango III aptamer

SEQ ID NO: 6837 - RNA, 45 nt, Artificial sequence; identical to SEQ ID NO: 6752
  Mango III aptamer

SEQ ID NO: 6838 - RNA, 45 nt, Artificial sequence; identical to SEQ ID NO: 6734
  Mango III aptamer

SEQ ID NO: 6839 - RNA, 45 nt, Artificial sequence; identical to SEQ ID NO: 6746
  Mango III aptamer

SEQ ID NO: 6840 - RNA, 45 nt, Artificial sequence; identical to SEQ ID NO: 6742
  Mango III aptamer

SEQ ID NO: 6841 - RNA, 45 nt, Artificial sequence; identical to SEQ ID NO: 6744
  Mango III aptamer

SEQ ID NO: 6842 - RNA, 45 nt, Artificial sequence; identical to SEQ ID NO: 6726
  Mango III aptamer

SEQ ID NO: 6843 - RNA, 45 nt, Artificial sequence; identical to SEQ ID NO: 6750
  Mango III aptamer

SEQ ID NO: 6844 - RNA, 45 nt, Artificial sequence; identical to SEQ ID NO: 6736
  Mango III aptamer

SEQ ID NO: 6845 - RNA, 45 nt, Artificial sequence; identical to SEQ ID NO: 6728
  Mango III aptamer

SEQ ID NO: 6846 - RNA, 45 nt, Artificial sequence; identical to SEQ ID NO: 6727
  Mango III aptamer

SEQ ID NO: 6847 - RNA, 53 nt, Artificial sequence; identical to SEQ ID NO: 6756
  Mango III aptamer

SEQ ID NO: 6848 - RNA, 53 nt, Artificial sequence; identical to SEQ ID NO: 6757
  Mango III aptamer

SEQ ID NO: 6849 - RNA, 45 nt, Artificial sequence
  Mango III aptamer
  misc_feature (32)..(32): n is a, c, g, or u
ggcacguacgaaggaaggauugguauguggunuauucguacgugc

SEQ ID NO: 6850 - RNA, 45 nt, Artificial sequence
  Mango III aptamer
  misc_feature (30)..(30): n is a, c, g, or u
ggcacguacgaaggaaggauugguaugugnuauauucguacgugc

SEQ ID NO: 6851 - RNA, 45 nt, Artificial sequence
  Mango III aptamer
  misc_feature (33)..(33): n is a, c, g, or u
ggcacguacgaaggaaggauugguaugugguanauucguacgugc

SEQ ID NO: 6852 - RNA, 45 nt, Artificial sequence; identical to SEQ ID NO: 6758
  Mango III aptamer

SEQ ID NO: 6853 - RNA, 45 nt, Artificial sequence; identical to SEQ ID NO: 6759
  Mango III aptamer

SEQ ID NO: 6854 - RNA, 45 nt, Artificial sequence; identical to SEQ ID NO: 6761
  Mango III aptamer

SEQ ID NO: 6855 - RNA, 44 nt, Artificial sequence; identical to SEQ ID NO: 6762
  Mango III aptamer

SEQ ID NO: 6856 - RNA, 45 nt, Artificial sequence
  Mango III aptamer
  misc_feature (19)..(19): n is a, c, g, or u
ggcacguacgaaggaaggnuugguaugugguauauucguacgugc

SEQ ID NO: 6857 - RNA, 45 nt, Artificial sequence; identical to SEQ ID NO: 6856
  Mango III aptamer
  misc_feature (19)..(19): n is a, c, g, or u

SEQ ID NO: 6858 - RNA, 45 nt, Artificial sequence; identical to SEQ ID NO: 6764
  Mango III aptamer

SEQ ID NO: 6859 - RNA, 45 nt, Artificial sequence; identical to SEQ ID NO: 6766
  Mango III aptamer

SEQ ID NO: 6860 - RNA, 45 nt, Artificial sequence; identical to SEQ ID NO: 6768
  Mango III aptamer

SEQ ID NO: 6861 - RNA, 45 nt, Artificial sequence; identical to SEQ ID NO: 6769
  Mango III aptamer

SEQ ID NO: 6862 - RNA, 45 nt, Artificial sequence; identical to SEQ ID NO: 6771
  Mango III aptamer

SEQ ID NO: 6863 - RNA, 45 nt, Artificial sequence; identical to SEQ ID NO: 6773
  Mango III aptamer

SEQ ID NO: 6864 - RNA, 45 nt, Artificial sequence; identical to SEQ ID NO: 6774
  Mango III aptamer

SEQ ID NO: 6865 - RNA, 45 nt, Artificial sequence; identical to SEQ ID NO: 6775
  Mango III aptamer

SEQ ID NO: 6866 - RNA, 45 nt, Artificial sequence; identical to SEQ ID NO: 6776
  Mango III aptamer

SEQ ID NO: 6867 - RNA, 45 nt, Artificial sequence; identical to SEQ ID NO: 6778
  Mango III aptamer

SEQ ID NO: 6868 - RNA, 45 nt, Artificial sequence; identical to SEQ ID NO: 6780
  Mango III aptamer

SEQ ID NO: 6869 - RNA, 45 nt, Artificial sequence; identical to SEQ ID NO: 6781
  Mango III aptamer

SEQ ID NO: 6870 - RNA, 43 nt, Artificial sequence; identical to SEQ ID NO: 6783
  Mango III aptamer

SEQ ID NO: 6871 - RNA, 44 nt, Artificial sequence; identical to SEQ ID NO: 6785
  Mango III aptamer

SEQ ID NO: 6872 - RNA, 45 nt, Artificial sequence; identical to SEQ ID NO: 6787
  Mango III aptamer

SEQ ID NO: 6873 - RNA, 45 nt, Artificial sequence; identical to SEQ ID NO: 6789
  Mango III aptamer

SEQ ID NO: 6874 - RNA, 45 nt, Artificial sequence; identical to SEQ ID NO: 6791
  Mango III aptamer

SEQ ID NO: 6875 - RNA, 45 nt, Artificial sequence; identical to SEQ ID NO: 6793
  Mango III aptamer

SEQ ID NO: 6876 - RNA, 41 nt, Artificial sequence
  Mango II aptmer
ggcacguacgaaggagaggagaggaagaggagaguacgugc

SEQ ID NO: 6877 - RNA, 41 nt, Artificial sequence
  Mango II aptmer
ggcacguacgaaggagaggagagguagaggagaguacgugc

SEQ ID NO: 6878 - RNA, 41 nt, Artificial sequence
  Mango II aptmer
ggcacguacgaaggagaggagaggcagaggagaguacgugc

SEQ ID NO: 6879 - RNA, 41 nt, Artificial sequence
  Mango II aptmer
ggcacguacgaaggagaggagagggagaggagaguacgugc

SEQ ID NO: 6880 - RNA, 41 nt, Artificial sequence
  Mango II aptmer
ggcacguacgaaggugaggagaggaagaggagaguacgugc

SEQ ID NO: 6881 - RNA, 41 nt, Artificial sequence
  Mango II aptmer
ggcacguacgaaggagaggugaggaagaggagaguacgugc

SEQ ID NO: 6882 - RNA, 41 nt, Artificial sequence
  Mango II aptmer
ggcacguacgaaggugaggugagguugaggugaguacgugc

SEQ ID NO: 6883 - RNA, 41 nt, Artificial sequence
  Mango II aptmer
ggcacguacgaaggugaggugagguagaggagaguacgugc

SEQ ID NO: 6884 - RNA, 41 nt, Artificial sequence; identical to SEQ ID NO: 6877
  Mango II aptmer

SEQ ID NO: 6885 - RNA, 41 nt, Artificial sequence; identical to SEQ ID NO: 6877
  Mango II aptmer

SEQ ID NO: 6886 - RNA, 41 nt, Artificial sequence; identical to SEQ ID NO: 6877
  Mango II aptmer

SEQ ID NO: 6887 - RNA, 41 nt, Artificial sequence; identical to SEQ ID NO: 6877
  Mango II aptmer

SEQ ID NO: 6888 - RNA, 23 nt, Artificial Sequence
  consensus mango
  misc_feature (2)..(2): n is a, c, g, or u
  misc_feature (7)..(8): n is a, c, g, or u
  misc_feature (11)..(11): n is a, c, g, or u
  misc_feature (13)..(13): n is a, c, g, or u
  misc_feature (18)..(18): n is a, c, g, or u
gnrgggnnggngnggagnggaga

SEQ ID NO: 6889 - DNA, 192 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtggggaaacccacatactctgatgatccttcgggatcattcatggcaatctaga

SEQ ID NO: 6890 - DNA, 218 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtgggtacgaattagattagattaagattagagtacccacatactctgatgatccttcgggatcattcatggcaatctaga

SEQ ID NO: 6891 - DNA, 217 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtgggtacgaagggacggtgcggagaggagagtacccacatactctgatgatccttcgggatcattcatggcaatctaga

SEQ ID NO: 6892 - DNA, 218 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtgggtacgaaggagaggagaggaagaggagagtacccacatactctgatgatccttcgggatcattcatggcaatctaga

SEQ ID NO: 6893 - DNA, 222 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtgggtacgaaggaaggattggtatgtggtatattcgtacccacatactctgatgatccttcgggatcattcatggcaatctaga

SEQ ID NO: 6894 - DNA, 219 bp, Artificial sequence
  construct table 2
gtctacggccataccaccctgaacgcgcccgatctcgtctgatctcggaagctaagcagggtcgggcctggttagtacttggatgggagaccgcctgggaataccgggtgctgtaggcgtcgacttgccatgtgtatgtgggtaccgagggagtggtgaggatgaggcgagtacccacatactctgatgatccttcgggatcattcatggcaatctaga

SEQ ID NO: 6895 - DNA, 196 bp, Artificial sequence
  construct table 2
gtctacggccataccaccctgaacgcgcccgatctcgtctgatctcggaagctaagcagggtcgggcctggttagtagaaagaataccgggtgctgtaggcgtcgacttgccatgtgtatgtgggtaccgagggagtggtgaggatgaggcgagtacccacatactctgatgatccttcgggatcattcatggcaa

SEQ ID NO: 6896 - DNA, 131 bp, Artificial sequence
  construct table 2
gtgctcgcttcggcagcacatatactaaaattggaacgatacagagaagattagcatggcccctaccgagggagtggtgaggatgaggcgagtaggatgacacgcaaattcgtgaagcgttccatattttt

SEQ ID NO: 6897 - DNA, 31 bp, Artificial sequence
  primer
cgctctagattgccatgaatgatcccgaagg

SEQ ID NO: 6898 - DNA, 45 bp, Artificial sequence
  T7 promoter
gccggatcctaatacgactcactatagtctacggccataccaccc

SEQ ID NO: 6899 - DNA, 30 bp, Artificial Sequence
  primer
ggcgtcgacttgccatgtgtatgtgggtac

SEQ ID NO: 6900 - DNA, 37 bp, Artificial Sequence
  primer forw
ctttaatacgactcactataggaacccgcaagccatc

SEQ ID NO: 6901 - DNA, 17 bp, Artificial Sequence
  primer reverse
cagaatctcacacagcc

SEQ ID NO: 6902 - RNA, 36 nt, Artificial sequence
  Mango Aptamer
gcguacgaaggagaggagaggaagaggagaguacgc

SEQ ID NO: 6903 - RNA, 36 nt, Artificial sequence
  Mango Aptamer
gcguacgaaggagaggagagguagaggagaguacgc

SEQ ID NO: 6904 - RNA, 41 nt, Artificial sequence; identical to SEQ ID NO: 6876
  Mango Aptamer

SEQ ID NO: 6905 - RNA, 41 nt, Artificial sequence; identical to SEQ ID NO: 6877
  Mango Aptamer

SEQ ID NO: 6906 - RNA, 41 nt, Artificial sequence; identical to SEQ ID NO: 6878
  Mango Aptamer

SEQ ID NO: 6907 - RNA, 41 nt, Artificial sequence; identical to SEQ ID NO: 6879
  Mango Aptamer

SEQ ID NO: 6908 - RNA, 41 nt, Artificial sequence; identical to SEQ ID NO: 6880
  Mango Aptamer

SEQ ID NO: 6909 - RNA, 41 nt, Artificial sequence; identical to SEQ ID NO: 6881
  Mango Aptamer

SEQ ID NO: 6910 - RNA, 41 nt, Artificial sequence; identical to SEQ ID NO: 6882
  Mango Aptamer

SEQ ID NO: 6911 - RNA, 41 nt, Artificial sequence; identical to SEQ ID NO: 6883
  Mango Aptamer

SEQ ID NO: 6912 - RNA, 40 nt, Artificial sequence
  aptamer
ggcacguacgaagggacggugcggagaggagaguacgugc

SEQ ID NO: 6913 - RNA, 41 nt, Artificial sequence; identical to SEQ ID NO: 6876
  aptamer

SEQ ID NO: 6914 - RNA, 46 nt, Artificial sequence
  aptamer
ggcacguacgaaggaaggauugguaugugguauauucguacgugcc

SEQ ID NO: 6915 - RNA, 42 nt, Artificial sequence
  aptamer
ggcacguaccgagggaguggugaggaugaggcgaguacgugc

SEQ ID NO: 6916 - RNA, 41 nt, Artificial sequence
  aptamer
ggcacguacgaaggggacggugcggagaggagaguacgugc

SEQ ID NO: 6917 - DNA, 92 bp, Artificial sequence
  aptamer
ggaacccgcaagccatccgtcgagggagtggtgaggatgaggcgaacggacgtgctttgcggatagaaatggtgtggctgtgtgagattctg

SEQ ID NO: 6918 - DNA, 92 bp, Artificial sequence
  aptamer
ggaacccgcaagccatccgtcgagggagtggcgaggatgaggcgaacggacgtgctttgcggatagaaatggtgtggctgtgtgagattctg

SEQ ID NO: 6919 - DNA, 92 bp, Artificial sequence
  aptamer
ggaacccgcaagccatccgtcgagggagtggcgaggatgaggcgaacggacgtgctttgcgggtagaaatggtgtggctgtgtgagattctg

SEQ ID NO: 6920 - DNA, 92 bp, Artificial sequence; identical to SEQ ID NO: 6919
  aptamer

SEQ ID NO: 6921 - DNA, 92 bp, Artificial sequence; identical to SEQ ID NO: 6919
  aptamer

SEQ ID NO: 6922 - DNA, 92 bp, Artificial sequence
  aptamer
ggaacccgcaagccatccgtcgagggagtggcgaggatgaggcgaacggacgtgctttgcgggtagaactggtgtggctgtgtgagattctg

SEQ ID NO: 6923 - DNA, 94 bp, Artificial sequence
  aptamer
ggaacccgcaagccatcggacggctagaaacagaatgtgaaacataaccgaaggaaggattggtatgtggtatattcggctgtgtgagattctg

SEQ ID NO: 6924 - DNA, 94 bp, Artificial sequence
  aptamer
ggaacccgcaagccatcgggtcctggcaaaagtattaaggagggtaggtgcggagtggagataatgctttagtctttggctgtgtgagattctg

SEQ ID NO: 6925 - DNA, 93 bp, Artificial sequence
  aptamer
ggaacccgcaagccatcaacggacgtgtttctatggagaggaagtgggtgttggtgaaaatgaagacacatacgttggctgtgtgagattctg

SEQ ID NO: 6926 - DNA, 93 bp, Artificial sequence; identical to SEQ ID NO: 6925
  aptamer

SEQ ID NO: 6927 - DNA, 87 bp, Artificial sequence
  aptamer
ggaacccgcaagccatctatgggagaatcaaagtcggcactaggagtggaagaggagtggagaggcgctaggctgtgtgagattctg

SEQ ID NO: 6928 - DNA, 94 bp, Artificial sequence
  aptamer
ggaacccgcaagccatcacaagtggttggtgggagggagaagtggtgtacgtgggttccgccttggtgagttcggatggctgtgtgagattctg

SEQ ID NO: 6929 - DNA, 94 bp, Artificial sequence
  aptamer
ggaacccgcaagccatcaggtgaagtgttgagtgcgggtctcatagctgttaagtgtggagtggagtggaagtggccggctgtgtgagattctg

SEQ ID NO: 6930 - DNA, 94 bp, Artificial sequence
  aptamer
ggaacccgcaagccatcgggtcctggcaaaagtattatgaagggtaggtgcggggtggaggtaatgctttagtcattggctgtgtgagattctg

SEQ ID NO: 6931 - DNA, 94 bp, Artificial sequence
  aptamer
ggaacccgcaagccatcacgttctactggtctaaggagaggaagagggtgttggggaaacggcttatgaactgtgctggctgtgtgagattctg

SEQ ID NO: 6932 - DNA, 92 bp, Artificial sequence
  aptamer
ggaacccgcaagccatcgtggaattcaggcgagtttgcagctgcatcgaagggtaggtgcggagtggggaggtgcggctgtgtgagattctg

SEQ ID NO: 6933 - DNA, 94 bp, Artificial sequence
  aptamer
ggaacccgcaagccatcggagagggcgggtggatgaggtctgtggggttccaactccgatttagccggtatctagatggctgtgtgagattctg

SEQ ID NO: 6934 - DNA, 94 bp, Artificial sequence
  aptamer
ggaacccgcaagccatcagcaagatcagttcagcggctcagggcgtgaaggagtggaagaggtgtggaggcgccccgggctgtgtgagattctg

SEQ ID NO: 6935 - DNA, 94 bp, Artificial sequence
  aptamer
ggaacccgcaagccatcagcaagatcagttccgcagctcagggcgtgagggagtggaagaggtgtggaggcgcccccggctgtgtgagattctg

SEQ ID NO: 6936 - DNA, 94 bp, Artificial sequence
  aptamer
ggaacccgcaagccatcagcaagatcagttccgcagctcagggcgtgaaggagtggaagaggtgtggaggcgccccgggctgtgtgagattctg

SEQ ID NO: 6937 - DNA, 94 bp, Artificial sequence; identical to SEQ ID NO: 6936
  aptamer

SEQ ID NO: 6938 - DNA, 94 bp, Artificial sequence
  aptamer
ggaacccgcaagccatcgcggccggcgacgttaaaccaacattcgagcagttgggctagcgggctccgcacaccgatggctgtgtgagattctg

SEQ ID NO: 6939 - DNA, 94 bp, Artificial sequence
  aptamer
ggaacccgcaagccatcgcggccggcgatgttaaaccgacattcgagcagttggactagcgggctccacacaccgatggctgtgtgagattctg

SEQ ID NO: 6940 - DNA, 94 bp, Artificial sequence
  aptamer
ggaacccgcaagccatcgcggccggcgacattaaaccaacattcgagcagttggactagcgggctccacacaccgatggctgtgtgagattctg

SEQ ID NO: 6941 - DNA, 94 bp, Artificial sequence
  aptamer
ggaacccgcaagccatcgcggccggcgacgttaaaccaacattcgagcagttggactatcgggctccacacaccgatggctgtgtgagattctg

SEQ ID NO: 6942 - DNA, 94 bp, Artificial sequence
  aptamer
ggaacccgcaagccatcgcggccggcgacgttaaatcaacattcgagcagttgagctagcgggctccgcacaccgatggctgtgtgagattctg

SEQ ID NO: 6943 - DNA, 93 bp, Artificial sequence
  aptamer
ggaacccgcaagccatcaggacgcctgaagcatggtgttgagttaggtggggtgtaaagctttaagacgtttctggggctgtgtgagattctg

SEQ ID NO: 6944 - DNA, 93 bp, Artificial sequence
  aptamer
ggaacccgcaagccatcaggacgcctgaagcatggtgtggagttaggtggggtgtaaagctttaagacgtttctggggctgtgtgagattctg

SEQ ID NO: 6945 - DNA, 93 bp, Artificial sequence; identical to SEQ ID NO: 6944
  aptamer

SEQ ID NO: 6946 - DNA, 93 bp, Artificial sequence
  aptamer
ggaacccgcaagccatcaggacgcctgaagcatggtgtggagttaggtggggtgtaaagctttaagacgtttctgtggctgtgtgagattctg

SEQ ID NO: 6947 - DNA, 93 bp, Artificial sequence; identical to SEQ ID NO: 6944
  aptamer

SEQ ID NO: 6948 - DNA, 93 bp, Artificial sequence
  aptamer
ggaacccgcaagccatccggacgcctgaagcatggtgtggagttaggtggggtgtaaagctttaagacgtttctggggctgtgtgagattctg

SEQ ID NO: 6949 - DNA, 93 bp, Artificial sequence
  aptamer
ggaacccgcaagccatcgggaccggccagaagtgcgtaccgaaggaggggagaggaagaggagagtgcgcgtgttgggctgtgtgagattctg

SEQ ID NO: 6950 - DNA, 92 bp, Artificial sequence
  aptamer
ggaacccgcaagccatcgagaccggccaaagtgcgtaccgaaggagaggagaggaagaggagagtgcgcgtgttgggctgtgtgagattctg

SEQ ID NO: 6951 - DNA, 93 bp, Artificial sequence
  aptamer
ggaacccgcaagccatcgggaccggccaaaagtgcgtaccgaaggagaggagaggaagaggagagtgcgcgtgttgggctgtgtgagattctg

SEQ ID NO: 6952 - DNA, 94 bp, Artificial sequence
  aptamer
ggaacccgcaagccatcggacggctagaaacagaatgtgaaacataaccgaaggaaggattggtacgtggtatattcggctgtgtgagattctg

SEQ ID NO: 6953 - DNA, 93 bp, Artificial sequence
  aptamer
ggaacccgcaagccatcgggaccggccaaaaatgcgtaccgaaggaggggagaggaagaggagagtgcgcgtgttgggctgtgtgagattctg

SEQ ID NO: 6954 - DNA, 93 bp, Artificial sequence
  aptamer
ggtacccgcaagccatcagaacgcctgaagcatggtgtggagttaggtggggtgtaaagctttaagacgtttctgaggctgtgtgagattctg

SEQ ID NO: 6955 - DNA, 94 bp, Artificial sequence; identical to SEQ ID NO: 6952
  aptamer

SEQ ID NO: 6956 - DNA, 94 bp, Artificial sequence; identical to SEQ ID NO: 6952
  aptamer

SEQ ID NO: 6957 - DNA, 94 bp, Artificial sequence
  aptamer
ggaacccgcaagccatcgggcggctagaaacagaatgtgaaacataaccgaaggaaggattggtacgtggtatattcggctgtgtgagattctg

SEQ ID NO: 6958 - DNA, 94 bp, Artificial sequence; identical to SEQ ID NO: 6952
  aptamer

SEQ ID NO: 6959 - DNA, 94 bp, Artificial sequence; identical to SEQ ID NO: 6952
  aptamer

SEQ ID NO: 6960 - DNA, 94 bp, Artificial sequence; identical to SEQ ID NO: 6952
  aptamer

SEQ ID NO: 6961 - DNA, 94 bp, Artificial sequence; identical to SEQ ID NO: 6952
  aptamer

SEQ ID NO: 6962 - DNA, 94 bp, Artificial sequence; identical to SEQ ID NO: 6952
  aptamer

SEQ ID NO: 6963 - DNA, 94 bp, Artificial sequence; identical to SEQ ID NO: 6952
  aptamer

SEQ ID NO: 6964 - DNA, 94 bp, Artificial sequence
  aptamer
ggaacccgcaagccatcggacggctagaaacagaatgtgaaacataatcgaaggaaggattggtacgtggtatattcggctgtgtgagattctg

SEQ ID NO: 6965 - DNA, 94 bp, Artificial sequence
  aptamer
ggaacccgcaagccatcggacggctagaaacaggatgtgaaacataaccgaaggaaggattggtacgtggtatattcggctgtgtgagattctg

SEQ ID NO: 6966 - DNA, 94 bp, Artificial sequence; identical to SEQ ID NO: 6952
  aptamer

SEQ ID NO: 6967 - DNA, 94 bp, Artificial sequence; identical to SEQ ID NO: 6952
  aptamer

SEQ ID NO: 6968 - DNA, 94 bp, Artificial sequence; identical to SEQ ID NO: 6952
  aptamer

SEQ ID NO: 6969 - DNA, 94 bp, Artificial sequence; identical to SEQ ID NO: 6952
  aptamer

SEQ ID NO: 6970 - DNA, 94 bp, Artificial sequence; identical to SEQ ID NO: 6952
  aptamer

SEQ ID NO: 6971 - DNA, 94 bp, Artificial sequence; identical to SEQ ID NO: 6952
  aptamer

SEQ ID NO: 6972 - DNA, 94 bp, Artificial sequence; identical to SEQ ID NO: 6952
  aptamer

SEQ ID NO: 6973 - DNA, 94 bp, Artificial sequence; identical to SEQ ID NO: 6952
  aptamer

SEQ ID NO: 6974 - DNA, 94 bp, Artificial sequence
  aptamer
ggaacccgcaagccatcggacggctagaaacagaatgtggaacataaccgaaggaaggattggtacgtggtatattcggctgtgtgagattctg

SEQ ID NO: 6975 - DNA, 94 bp, Artificial sequence; identical to SEQ ID NO: 6952
  aptamer

SEQ ID NO: 6976 - DNA, 94 bp, Artificial sequence; identical to SEQ ID NO: 6952
  aptamer

SEQ ID NO: 6977 - DNA, 94 bp, Artificial sequence; identical to SEQ ID NO: 6952
  aptamer

SEQ ID NO: 6978 - DNA, 94 bp, Artificial sequence
  aptamer
ggaacccgcaagccatcggacggctagaaacagaatgtgaaacattaccgaaggaaggattggtacgtggtatattcggctgtgtgagattctg

SEQ ID NO: 6979 - DNA, 94 bp, Artificial sequence; identical to SEQ ID NO: 6923
  aptamer

SEQ ID NO: 6980 - DNA, 94 bp, Artificial sequence; identical to SEQ ID NO: 6923
  aptamer

SEQ ID NO: 6981 - DNA, 94 bp, Artificial sequence; identical to SEQ ID NO: 6923
  aptamer

SEQ ID NO: 6982 - DNA, 94 bp, Artificial sequence; identical to SEQ ID NO: 6923
  aptamer

SEQ ID NO: 6983 - DNA, 94 bp, Artificial sequence; identical to SEQ ID NO: 6923
  aptamer

SEQ ID NO: 6984 - DNA, 94 bp, Artificial sequence; identical to SEQ ID NO: 6923
  aptamer

SEQ ID NO: 6985 - DNA, 94 bp, Artificial sequence
  aptamer
ggaacccgcaagccatcagacggctagaaacagaatgtgaaacataaccgaaggaaggattggtatgtggtatattcggctgtgtgagattctg

SEQ ID NO: 6986 - DNA, 94 bp, Artificial sequence; identical to SEQ ID NO: 6923
  aptamer

SEQ ID NO: 6987 - DNA, 94 bp, Artificial sequence; identical to SEQ ID NO: 6923
  aptamer

SEQ ID NO: 6988 - DNA, 94 bp, Artificial sequence; identical to SEQ ID NO: 6923
  aptamer

SEQ ID NO: 6989 - DNA, 94 bp, Artificial sequence
  aptamer
ggaacccgcaagccatcggacggccagaaacagaatgtgaaacataaccgaaggaaggattggtatgtggtatattcggctgtgtgagattctg

SEQ ID NO: 6990 - DNA, 94 bp, Artificial sequence; identical to SEQ ID NO: 6923
  aptamer

SEQ ID NO: 6991 - DNA, 94 bp, Artificial sequence
  aptamer
ggaacccgcaagccatcggacggctagaaacagaatgtgaaacataaccgaaggaaggattggtatgtgatatattcggctgtgtgagattctg

SEQ ID NO: 6992 - DNA, 94 bp, Artificial sequence; identical to SEQ ID NO: 6923
  aptamer

SEQ ID NO: 6993 - DNA, 94 bp, Artificial sequence; identical to SEQ ID NO: 6923
  aptamer

SEQ ID NO: 6994 - DNA, 94 bp, Artificial sequence; identical to SEQ ID NO: 6923
  aptamer

SEQ ID NO: 6995 - DNA, 94 bp, Artificial sequence; identical to SEQ ID NO: 6923
  aptamer

SEQ ID NO: 6996 - DNA, 94 bp, Artificial sequence
  aptamer
ggaacccgcaagccatcggacggctagaaacagaatttgaaacataaccgaaggaaggattggtatgtggtatattcggctgtgtgagattctg

SEQ ID NO: 6997 - DNA, 94 bp, Artificial sequence; identical to SEQ ID NO: 6996
  aptamer

SEQ ID NO: 6998 - DNA, 94 bp, Artificial sequence; identical to SEQ ID NO: 6923
  aptamer

SEQ ID NO: 6999 - DNA, 94 bp, Artificial sequence; identical to SEQ ID NO: 6923
  aptamer

SEQ ID NO: 7000 - DNA, 94 bp, Artificial sequence
  aptamer
ggaacccgcaagccatcgaacggctagaaacagaatgtgaaacataaccgaaggaaggattggtatgtggtatattcggctgtgtgagattctg

SEQ ID NO: 7001 - DNA, 94 bp, Artificial sequence; identical to SEQ ID NO: 7000
  aptamer

SEQ ID NO: 7002 - DNA, 94 bp, Artificial sequence; identical to SEQ ID NO: 6923
  aptamer

SEQ ID NO: 7003 - DNA, 94 bp, Artificial sequence; identical to SEQ ID NO: 6923
  aptamer

SEQ ID NO: 7004 - DNA, 94 bp, Artificial sequence; identical to SEQ ID NO: 6923
  aptamer

SEQ ID NO: 7005 - DNA, 45 bp, Artificial sequence
  aptamer
gtgcgtaccgaaggagaggagaggaagaggagagtgcgcgtgttg

SEQ ID NO: 7006 - DNA, 41 bp, Artificial sequence
  aptamer
ggcacgtacgaaggagaggagaggaagaggagagtacgtgc

SEQ ID NO: 7007 - DNA, 40 bp, Artificial sequence
  aptamer
ggcacgtacgaaggagaggtgcggagaggagagtacgtgc

SEQ ID NO: 7008 - DNA, 40 bp, Artificial sequence
  aptamer
ggcacgtacgaagggacggagaggagaggagagtacgtgc

SEQ ID NO: 7009 - DNA, 41 bp, Artificial sequence
  aptamer
ggcacgtacgaagggacggtgcggaagaggagagtacgtgc

SEQ ID NO: 7010 - DNA, 40 bp, Artificial sequence
  aptamer
ggcacgtacgaaggagaggagaggagaggagagtacgtgc

SEQ ID NO: 7011 - DNA, 41 bp, Artificial sequence
  aptamer
ggcacgtacgaaggagaggtgcggaagaggagagtacgtgc

SEQ ID NO: 7012 - DNA, 41 bp, Artificial sequence
  aptamer
ggcacgtacgaagggacggagaggaagaggagagtacgtgc

SEQ ID NO: 7013 - DNA, 41 bp, Artificial sequence
  aptamer
ggcacgtacgaaggagaggagaggatgaggagagtacgtgc

SEQ ID NO: 7014 - DNA, 56 bp, Artificial sequence
  aptamer
acccgcaagccatccgtcgagggagtggtgaggatgaggcgaacggacgtgctttg

SEQ ID NO: 7015 - DNA, 42 bp, Artificial sequence
  aptamer
ggcacgtaccgagggagtggtgaggatgaggcgagtacgtgc

SEQ ID NO: 7016 - DNA, 36 bp, Artificial sequence
  aptamer
gggagtggtgaggatgaggcgaacggacgtgctttg

SEQ ID NO: 7017 - DNA, 15 bp, Artificial sequence
  aptamer
ggcggacgtgctttg

SEQ ID NO: 7018 - DNA, 56 bp, Artificial sequence
  aptamer
ggccgcaagccatccgtcgagggagtggtgaggatgaggcgaacggacgtgctttg

SEQ ID NO: 7019 - DNA, 48 bp, Artificial sequence
  aptamer
ggaagcctccgtcgagggagtggtgaggatgaggcgaacggagtgctt

SEQ ID NO: 7020 - DNA, 42 bp, Artificial sequence
  aptamer
ggacgtactcgagggagtggtgaggatgaggcgaagtacgtc

SEQ ID NO: 7021 - DNA, 41 bp, Artificial sequence
  aptamer
ggcacgtacgagggagtggtgaggatgaggcgagtacgtgc

SEQ ID NO: 7022 - DNA, 39 bp, Artificial sequence
  aptamer
ggcacgtacagggagtggtgaggatgaggcggtacgtgc

SEQ ID NO: 7023 - DNA, 42 bp, Artificial sequence
  aptamer
ggcacgtacgaagggagtggtgaggatgaggagagtacgtgc

SEQ ID NO: 7024 - DNA, 41 bp, Artificial sequence
  aptamer
ggcacgtaccgagggacggtgaggatgaggcgagtacgtgc

SEQ ID NO: 7025 - DNA, 42 bp, Artificial sequence
  aptamer
ggcacgtaccgagggagtggtgcggatgaggcgagtacgtgc

SEQ ID NO: 7026 - DNA, 41 bp, Artificial sequence
  aptamer
ggcacgtaccgagggagtggtgaggagaggcgagtacgtgc

SEQ ID NO: 7027 - DNA, 42 bp, Artificial sequence
  aptamer
ggcacgtaccgaggaagtggtgaggatgaggcgagtacgtgc

SEQ ID NO: 7028 - DNA, 41 bp, Artificial sequence
  aptamer
ggcacgtaccgaggagtggtgaggatgaggcgagtacgtgc

SEQ ID NO: 7029 - DNA, 42 bp, Artificial sequence
  aptamer
ggcacgtaccgagggaatggtgaggatgaggcgagtacgtgc

SEQ ID NO: 7030 - DNA, 41 bp, Artificial sequence
  aptamer
ggcacgtaccgagggatggtgaggatgaggcgagtacgtgc

SEQ ID NO: 7031 - DNA, 41 bp, Artificial sequence
  aptamer
ggcacgtaccgaggagaggtgaggatgaggcgagtacgtgc

SEQ ID NO: 7032 - DNA, 42 bp, Artificial sequence
  aptamer
ggcacgtaccgagggagtggtgaggaagaggcgagtacgtgc

SEQ ID NO: 7033 - DNA, 42 bp, Artificial sequence
  aptamer
ggcacgtaccgagggagtggtgaggatgaggagagtacgtgc

SEQ ID NO: 7034 - DNA, 42 bp, Artificial sequence
  aptamer
ggcacgtaccgagggagtggtgaggatgaggcaagtacgtgc

SEQ ID NO: 7035 - DNA, 42 bp, Artificial sequence
  aptamer
ggcacgtacgaagggagtggtgaggatgaggcgagtacgtgc

SEQ ID NO: 7036 - DNA, 58 bp, Artificial sequence
  aptamer
gtgaaacataaccgaaggaaggattggtatgtggtatattcggctgtgtgagattctg

SEQ ID NO: 7037 - DNA, 46 bp, Artificial sequence
  aptamer
ggcacgtacgaaggaaggattggtatgtggtatattcgtacgtgcc

SEQ ID NO: 7038 - DNA, 57 bp, Artificial sequence
  aptamer
gtgaaacataaccgaaggaaggattggtatgtggtatattcggctgtgtgagattct

SEQ ID NO: 7039 - DNA, 50 bp, Artificial sequence
  aptamer
gtgaaacataaccgaaggaaggattggtatgtggtatattcggctgtgtg

SEQ ID NO: 7040 - DNA, 58 bp, Artificial sequence; identical to SEQ ID NO: 7036
  aptamer

SEQ ID NO: 7041 - DNA, 48 bp, Artificial sequence
  aptamer
ggcgaaggaaggattggtatgtggtatattcggctgtgtgagattctg

SEQ ID NO: 7042 - DNA, 58 bp, Artificial sequence; identical to SEQ ID NO: 7036
  aptamer

SEQ ID NO: 7043 - DNA, 50 bp, Artificial sequence; identical to SEQ ID NO: 7039
  aptamer

SEQ ID NO: 7044 - DNA, 55 bp, Artificial sequence
  aptamer
ggacataaccgaaggaaggattggtatgtggtatattcggctgtgtgagattctg

SEQ ID NO: 7045 - DNA, 40 bp, Artificial sequence
  aptamer
ggcacggaaggaaggattggtatgtggtatattccgtgcc

SEQ ID NO: 7046 - DNA, 40 bp, Artificial sequence
  aptamer
ggcacgtacggaaggattggtatgtggtatagtacgtgcc

SEQ ID NO: 7047 - DNA, 37 bp, Artificial sequence
  aptamer
ggcacggaaggaaggattggtatgtggtatacgtgcc

SEQ ID NO: 7048 - DNA, 37 bp, Artificial sequence
  aptamer
ggcacgggaaggattggtatgtggtatattccgtgcc

SEQ ID NO: 7049 - RNA, 10 nt, Artificial sequence
  aptamer
ggacaauagc

SEQ ID NO: 7050 - RNA, 9 nt, Artificial sequence
  aptamer
acguagccu

SEQ ID NO: 7051 - RNA, 21 nt, Artificial sequence
  aptamer
ggaggcuacgugcuauugucc

SEQ ID NO: 7052 - RNA, 22 nt, Artificial sequence
  aptamer
ggaggcuacguagcuauugucc

SEQ ID NO: 7053 - RNA, 23 nt, Artificial sequence
  aptamer
ggaggcuacguaagcuauugucc

SEQ ID NO: 7054 - RNA, 10 nt, Artificial sequence
  aptamer
aacguagccu

SEQ ID NO: 7055 - RNA, 10 nt, Artificial sequence
  aptamer
ggacaauagc

SEQ ID NO: 7056 - RNA, 10 nt, Artificial sequence
  aptamer
uacguagccu

SEQ ID NO: 7057 - RNA, 11 nt, Artificial sequence
  aptamer
ggacaauagcu

SEQ ID NO: 7058 - RNA, 54 nt, Artificial sequence
  aptamer
gguugcacaugccgagggacggugcggagaggagacgauaucgucauccauggc

SEQ ID NO: 7059 - RNA, 33 nt, Artificial sequence
  aptamer
gggccauggaugacgauaucgcggcaugugcaa

SEQ ID NO: 7060 - RNA, 58 nt, Artificial sequence
  aptamer
ggaaggguguaaaagggacggugcggagcggagacgcagcucaguaacaguccgccua

SEQ ID NO: 7061 - RNA, 38 nt, Artificial sequence
  aptamer
gguaggcggacuguuuacugagcugcguuuacacccuu

SEQ ID NO: 7062 - RNA, 41 nt, Artificial sequence
  aptamer
ggacaauagcaggagaggagaggaagaggagaacguagccu

SEQ ID NO: 7063 - RNA, 21 nt, Artificial sequence
  aptamer
ggaggcuacgugcuauugucc

SEQ ID NO: 7064 - RNA, 41 nt, Artificial sequence; identical to SEQ ID NO: 7062
  aptamer

SEQ ID NO: 7065 - RNA, 19 nt, Artificial sequence
  aptamer
aggcuacgugcuauugucc

SEQ ID NO: 7066 - RNA, 48 nt, Artificial sequence
  aptamer
ggacaauagcaggagaggagaggaagaggagaacguagccucuccgcu

SEQ ID NO: 7067 - RNA, 26 nt, Artificial sequence
  aptamer
ggagcaaaggcuacgugcuauugucc

SEQ ID NO: 7068 - RNA, 48 nt, Artificial sequence; identical to SEQ ID NO: 7066
  aptamer

SEQ ID NO: 7069 - RNA, 26 nt, Artificial sequence
  aptamer
ggagcaaaggcuacgugcuauugucc

SEQ ID NO: 7070 - RNA, 51 nt, Artificial sequence
  aptamer
ggacaauagcaggagaggagaggaagaggagaacguagccugcuccgcucc

SEQ ID NO: 7071 - RNA, 52 nt, Artificial sequence
  aptamer
ggacaauagcaggagaggagaggaagaggagaacguagccugcuccugcucc

SEQ ID NO: 7072 - RNA, 53 nt, Artificial sequence
  aptamer
ggacaauagcaggagaggagaggaagaggagaacguagccugcuccucgcucc

SEQ ID NO: 7073 - RNA, 54 nt, Artificial sequence
  aptamer
ggacaauagcaggagaggagaggaagaggagaacguagccugcuccucugcucc

SEQ ID NO: 7074 - RNA, 55 nt, Artificial sequence
  aptamer
ggacaauagcaggagaggagaggaagaggagaacguagccugcuccucuugcucc

SEQ ID NO: 7075 - DNA, 43 bp, Artificial sequence
  aptamer
  misc_feature (33)..(33): n is a, c, g, or t
ggacaatagcagaggagtggtgaggatgaggcnaacgtagcct

SEQ ID NO: 7076 - DNA, 39 bp, Artificial sequence
  aptamer
ggacaatagcaggagtggtgaggatgaggaacgtagcct

SEQ ID NO: 7077 - DNA, 40 bp, Artificial sequence
  aptamer
ggacaatagcaaggagtggtgaggatgaggaacgtagcct

SEQ ID NO: 7078 - DNA, 41 bp, Artificial sequence
  aptamer
ggacaatagcagaggagtggtgaggatgaggaacgtagcct

SEQ ID NO: 7079 - DNA, 41 bp, Artificial sequence
  aptamer
ggacaatagcaaggagtggtgaggatgaggcaacgtagcct

SEQ ID NO: 7080 - DNA, 42 bp, Artificial sequence
  aptamer
ggacaatagcaaggagtggtgaggatgaggcgaacgtagcct

SEQ ID NO: 7081 - DNA, 43 bp, Artificial sequence
  aptamer
ggacaatagcaaggagtggtgaggatgaggcgaaacgtagcct

SEQ ID NO: 7082 - DNA, 42 bp, Artificial sequence
  aptamer
ggacaatagcagaggagtggtgaggatgaggcaacgtagcct

SEQ ID NO: 7083 - DNA, 43 bp, Artificial sequence
  aptamer
ggacaatagcagaggagtggtgaggatgaggcgaacgtagcct

SEQ ID NO: 7084 - DNA, 44 bp, Artificial sequence
  aptamer
ggacaatagcagaggagtggtgaggatgaggcgaaacgtagcct

SEQ ID NO: 7085 - DNA, 43 bp, Artificial sequence
  aptamer
ggacaatagcacgaggagtggtgaggatgaggcaacgtagcct

SEQ ID NO: 7086 - DNA, 43 bp, Artificial sequence; identical to SEQ ID NO: 7085
  aptamer

SEQ ID NO: 7087 - DNA, 45 bp, Artificial sequence
  aptamer
ggacaatagcacgaggagtggtgaggatgaggcgaaacgtagcct

SEQ ID NO: 7088 - DNA, 36 bp, Artificial sequence
  aptamer
taggcggactatgacttagttgcgttacaccctttc

SEQ ID NO: 7089 - DNA, 61 bp, Artificial sequence
  aptamer
gggaaagggtgtaaaggagaggagaggaagaggagacgcaactaagtcctccttccgccta

SEQ ID NO: 7090 - DNA, 32 bp, Artificial sequence
  aptamer
taggcggagacttagttgcgttacaccctttc

SEQ ID NO: 7091 - DNA, 36 bp, Artificial sequence
  aptamer
cgaggcccagagagagaggcatcctcaccctgaagt

SEQ ID NO: 7092 - DNA, 65 bp, Artificial sequence
  aptamer
ggacttcagggtgaaggagaggagaggaagaggagaggatgcctctctctcctctctgggcctcg

SEQ ID NO: 7093 - DNA, 40 bp, Artificial sequence
  aptamer
ggcgaggcccagagcaagagaggcatcctcaccctgaagt

SEQ ID NO: 7094 - DNA, 32 bp, Artificial sequence
  aptamer
ggcacccagcacaatgaagatcaagatcattg

SEQ ID NO: 7095 - DNA, 59 bp, Artificial sequence
  aptamer
ggcaatgatcttaggagaggagaggaagaggagagatcttcattctcctgtgctgggtg

SEQ ID NO: 7096 - DNA, 32 bp, Artificial sequence; identical to SEQ ID NO: 7094
  aptamer

SEQ ID NO: 7097 - DNA, 30 bp, Artificial sequence
  aptamer
aactggaacggtgaaggtgacagcagtcgg

SEQ ID NO: 7098 - DNA, 59 bp, Artificial sequence
  aptamer
ggccgactgctgaggagaggagaggaagaggagatcaccttcacctcctcgttccagtt

SEQ ID NO: 7099 - DNA, 32 bp, Artificial sequence
  aptamer
ggaactggaacggtgaaggtgacagcagtcgg

SEQ ID NO: 7100 - RNA, 60 nt, Artificial sequence
  aptamer
gguugcacaugccgagggacggugcggagaggagagagccguugucuccacgaccagcgc

SEQ ID NO: 7101 - RNA, 35 nt, Artificial sequence
  aptamer
gcgcuggucgucgacaacggcuccggcaugugcaa

SEQ ID NO: 7102 - RNA, 62 nt, Artificial sequence
  aptamer
gguugcacaugccgaggagaggagaggaagaggagagagccguugucuccuacgaccagcgc

SEQ ID NO: 7103 - RNA, 35 nt, Artificial sequence; identical to SEQ ID NO: 7101
  aptamer

SEQ ID NO: 7104 - DNA, 62 bp, Artificial sequence
  aptamer
ggttgcacatgccgaggagaggagaggaagaggagagagccgttgtctcctacgaccagcgc

SEQ ID NO: 7105 - DNA, 42 bp, Artificial sequence
  aptamer
ggatctcaacaatttctaccagcaagccagcgtaaatgcgcc

SEQ ID NO: 7106 - RNA, 36 nt, Artificial sequence
  aptamer
gcauacgaaggagaggagaggaagaggagaguaugc

SEQ ID NO: 7107 - RNA, 23 nt, Artificial sequence
  aptamer
gaagggacggugcggagaggaga

SEQ ID NO: 7108 - RNA, 28 nt, Artificial sequence
  aptamer
gaaggaaggauugguaugugguauauuc

SEQ ID NO: 7109 - RNA, 38 nt, Artificial sequence
  aptamer
gcuacgaaggaaggauugguaugugguauauucguagc

SEQ ID NO: 7110 - RNA, 28 nt, Artificial sequence
  aptamer
gaaggaaggauugguaugugguauauuc

SEQ ID NO: 7111 - RNA, 28 nt, Artificial sequence
  aptamer
  misc_feature (3)..(3): n is a, c, g, or u
  misc_feature (7)..(7): n is a, c, g, or u
  misc_feature (10)..(10): n is a, c, g, or u
  misc_feature (12)..(12): n is a, c, g, or u
  misc_feature (17)..(17): n is a, c, g, or u
  misc_feature (19)..(19): n is a, c, g, or u
  misc_feature (21)..(21): n is a, c, g, or u
  misc_feature (24)..(26): n is a, c, g, or u
gangganggnungguangngnuannnuc

SEQ ID NO: 7112 - RNA, 29 nt, Artificial sequence
  aptamer
  misc_feature (3)..(3): n is a, c, g, or u
  misc_feature (7)..(7): n is a, c, g, or u
  misc_feature (10)..(10): n is a, c, g, or u
  misc_feature (12)..(12): n is a, c, g, or u
  misc_feature (17)..(17): n is a, c, g, or u
  misc_feature (19)..(19): n is a, c, g, or u
  misc_feature (21)..(21): n is a, c, g, or u
  misc_feature (24)..(27): n is a, c, g, or u
gangganggnungguangngnuannnnuc

SEQ ID NO: 7113 - RNA, 29 nt, Artificial sequence
  aptamer
gaaggaagguuugguaugggguaguuguc

SEQ ID NO: 7114 - RNA, 29 nt, Artificial sequence
  aptamer
gaaggacgguuugguaugugguagugguc

SEQ ID NO: 7115 - RNA, 29 nt, Artificial sequence
  aptamer
gauggacgguuugguaugugguagugguc

SEQ ID NO: 7116 - RNA, 29 nt, Artificial sequence
  aptamer
gaaggaagguuugguaugagguaguuguc

SEQ ID NO: 7117 - RNA, 45 nt, Artificial sequence; identical to SEQ ID NO: 6726
  aptamer

SEQ ID NO: 7118 - RNA, 45 nt, Artificial sequence; identical to SEQ ID NO: 6727
  aptamer

SEQ ID NO: 7119 - RNA, 45 nt, Artificial sequence; identical to SEQ ID NO: 6728
  aptamer

SEQ ID NO: 7120 - RNA, 45 nt, Artificial sequence; identical to SEQ ID NO: 6730
  aptamer

SEQ ID NO: 7121 - RNA, 45 nt, Artificial sequence; identical to SEQ ID NO: 6732
  aptamer

SEQ ID NO: 7122 - RNA, 45 nt, Artificial sequence; identical to SEQ ID NO: 6734
  aptamer

SEQ ID NO: 7123 - RNA, 45 nt, Artificial sequence; identical to SEQ ID NO: 6736
  aptamer

SEQ ID NO: 7124 - RNA, 45 nt, Artificial sequence; identical to SEQ ID NO: 6738
  aptamer

SEQ ID NO: 7125 - RNA, 45 nt, Artificial sequence; identical to SEQ ID NO: 6740
  aptamer

SEQ ID NO: 7126 - RNA, 45 nt, Artificial sequence; identical to SEQ ID NO: 6742
  aptamer

SEQ ID NO: 7127 - RNA, 45 nt, Artificial sequence; identical to SEQ ID NO: 6744
  aptamer

SEQ ID NO: 7128 - RNA, 45 nt, Artificial sequence; identical to SEQ ID NO: 6746
  aptamer

SEQ ID NO: 7129 - RNA, 45 nt, Artificial sequence; identical to SEQ ID NO: 6748
  aptamer

SEQ ID NO: 7130 - RNA, 45 nt, Artificial sequence; identical to SEQ ID NO: 6750
  aptamer

SEQ ID NO: 7131 - RNA, 45 nt, Artificial sequence; identical to SEQ ID NO: 6728
  aptamer

SEQ ID NO: 7132 - RNA, 45 nt, Artificial sequence; identical to SEQ ID NO: 6736
  aptamer

The invention claimed is:
1. A RNA aptamer comprising an active core sequence as set forth in:

(SEQ ID NO: 2)
5'- GG@(T$_1$/WGW)GG(#$_1$H/WG)WGGN@(#$_2$/-)G(T$_2$/H)GNH
(AN@T$_3$/G)-3' with the proviso that the active core sequence is not the sequence as set forth in SEQ ID NO: 1: GAAGGGACG-GUGCGGAGAGGAGA
wherein, within the active core sequence:
  represents no nucleotide (gap);
  K represents U or G;
  S represents C or G;
  R represents A or G;
  W represents A or U;
  H represents A, C or U;
  N represents A, C, G or U; and
  @ represents N or a deletion;
and wherein T$_1$ represents any nucleotide, T$_2$ and T$_3$ being defined as follows:
when T$_1$ is A, T$_2$ can be either A, G or U; and
  when T$_1$ is A and T$_2$ is A, then T$_3$ is U;
  when T$_1$ is A and T$_2$ is G, then T$_3$ is U; and
  when T$_1$ is A and T$_2$ is U, then T$_3$ is A or U; or
when T$_1$ is C, T$_2$ can be either G or U; and
  when T$_1$ is C and T$_2$ is G, then T$_3$ is C or G; and
  when T$_1$ is C and T$_2$ is U, then T$_3$ is G; or
when T$_1$ is G, T$_2$ can be either G or C, and T$_3$ is C; or
when T$_1$ is U, T$_2$ can be either A or C; and
  when T$_1$ is U and T$_2$ is A, then T$_3$ is A or U; and
  when T$_1$ is U and T$_2$ is C, then T$_3$ is A;
  wherein #$_1$ and #$_2$ represents any nucleotide pair such that
    when #$_1$ is A, then #$_2$ represents A, C, G or U; or
    when #$_1$ is C, then #$_2$ is C; or
    when #$_1$ is G, then #$_2$ is G; or
    when #$_1$ is U, then #$_2$ represents A, G or U;
wherein the aptamer adopts a determined tridimensional conformation which is a fluorophore binding conformation, said aptamer when it adopts the fluorophore binding conformation being liable interact with a fluorophore;
wherein the aptamer further comprises, contiguous with the active core sequence, a 5' leader sequence attached, or operably linked to (by covalent bound, i.e. phosphodiester bound), to the 5' terminus of the active core and a 3' tail sequence attached, or operably linked to (by covalent bridge mentioned below), to the 3' terminus of the active core, and wherein the 5' leader sequence and the 3' tail sequence together mediate the juxtaposition of the 5' terminus of the active core and the 3' terminus of the active core when the aptamer is the fluorophore binding conformation.

2. The aptamer according to claim 1, wherein said aptamer can interact with a fluorophore, said fluorophore being selected from group consisting of the following compounds of the following Formula I and Formula II:

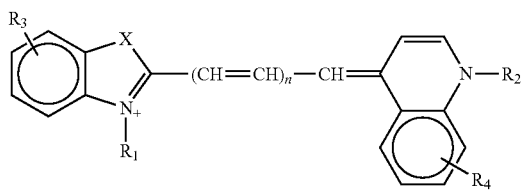

(I)

wherein:
  X represents O, S, Se, or C(CH$_3$)$_n$;
  R$_1$ represents an alkyl having from 1-6 carbons;
  R$_2$ represents an alkyl having from 1-6 carbons;
  R$_3$ is either a fused benzene, an alkyl having 1-6 carbons, a methoxy or H;
  R$_4$ is an alkyl having 1-6 carbons, a methoxy or H; and
  n=zero or an integer from 1-6;

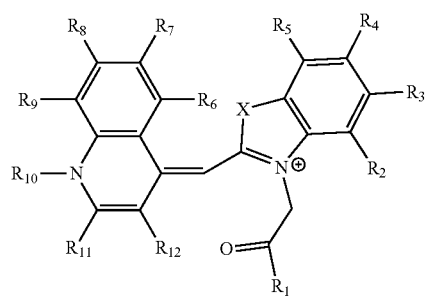

(II)

wherein:
  R$_1$ represents any substituent;
  R$_2$ through R$_5$ represent H, F, Cl, Br, I, CH$_3$, linear polymers, or extended heterocycles
  R$_6$-R$_9$ represent H, F, Cl, Br, I, CH$_3$, linear polymers, or extended heterocycles
  R$_{10}$ represents H, F, Cl, Br, I, CH$_3$, linear polymers, or extended heterocycles,
  R$_{11}$ through R$_{12}$ represent H, F, Cl, Br, I, CH$_3$, linear polymers, or extended heterocycles
  X represents the following atoms O, S and Se; and
  n is 1 or 3 or 5.

3. The aptamer according to claim 1, wherein the core active sequence comprises the following sequence:

(SEQ ID NO: 5)
5'-$\$_1$GGNT$_1$GG#$_1$HUGGHA#$_2$GT$_2$GNHAN@T$_3\$_2$-3' wherein:
H represents A, C or U
N represents A, C, G or U
@ represents any nucleotide or no nucleotide
$_1$ and #$_2$ represents any nucleotide pair such that
  when #$_1$ is A, then #$_2$ represents A, C, G or U; or
  when #$_1$ is C, then #$_2$ is C; or
  When #$_1$ is G, then #$_2$ is G; or
  when #$_1$ is U, then #$_2$ represents A, G or U,
$\$_1$ and $\$_2$ represent any pair of nucleotides such that
when $\$_1$ is A, then $\$_2$ is A, G or U; or
when $\$_1$ is C, then $\$_2$ is A, G or U; or
when $\$_1$ is G, then $\$_2$ is A, C, G or U; or
when $\$_1$ is U, then $\$_2$ is A, G.

4. The RNA aptamer according to claim 1, wherein the core active sequence comprises the following sequence:

(SEQ ID NO: 6)
GG@WGWGGWGWGGN@GHGGHG wherein:
W represents A or U;
H represents A, C or U;
N represents A, C, G or U; and
@ represents N or a no nucleotide.

5. The RNA aptamer according to claim 1, wherein the core active sequence comprises the following sequence:

$$\text{GAA(GG)}_1\text{AA(GG)}_2\text{NUU(GG)}_3\text{UAN'G}_{4i}\text{UG}_{4ii}\text{GUAUAUUC} \quad \text{(SEQ ID NO: 7)}$$

wherein:
N is any nucleotide, N' the anti-watson crick partner to N wherein $(GG)_1$, $(GG)_2$, $(GG)_3$ and $G_{4i}$ and $G_{4ii}$ form a quadruplex structure when the active core is in the fluorophore binding conformation, with the 5' terminus of the active core being juxtaposed to the 3' terminus of the active core.

6. The RNA aptamer according to claim 1, wherein the core active sequence comprises the following sequence:

$$\text{[G/C]NR(GG)}_1\text{[R/D]AG[A/U](GG)}_2\text{NGN(GG)}_3\text{A*[A/U/D]GA*} \quad \text{(SEQ ID NO: 8)}$$
$$\text{(GG)}_4\text{[A/C]R[A/D]}$$

wherein:
A* is A or N,
N is any nucleotide
R is a purine,
D denotes the absence of nucleotide,
wherein $(GG)_1$, $(GG)_2$, $(GG)_3$ and $(GG)_4$ form a quadruplex structure when the active core is in the fluorophore binding conformation, with the 5' terminus of the active core being juxtaposed to the 3' terminus of the active core.

7. The RNA aptamer according to claim 1, wherein the core active sequences comprises one of the sequences as set forth in SEQ ID NO: 7 to SEQ ID NO: 6887.

8. The RNA aptamer comprising a core active sequence as defined in claim 1, with the proviso that said aptamer active core does not have the core sequence: GNR(GG)$_1$GNN (GG)$_2$NGN(GG)$_3$AGN(GG)$_4$AGA SEQ ID NO: 6888, wherein R is a purine, and N is any nucleotide.

9. The RNA aptamer according to claim 1, wherein the 5' leader sequence and the 3' tail sequence are complementary, so that binding of the 5' leader sequence to the 3' tail sequence mediates the juxtaposition of the 5' terminus of the active core and the 3' terminus of the active core when the aptamer is the fluorophore binding conformation.

10. The RNA aptamer according to claim 1, wherein the 5' leader sequence and the 3' tail sequence are complementary to a target sequence, the target sequence comprising:
a leader bait sequence that is complementary to the 3' tail sequence of the aptamer; and,
a tail bait sequence that is complementary to the 5' leader sequence of the aptamer;
the leader and tail bait sequences being juxtaposed in the target sequence, so that binding of:
the 5' leader sequence to the tail bait sequence; combined with,
binding of the 3' tail sequence to the leader bait sequence;
mediates the juxtaposition of the 5' terminus of the active core and the 3' terminus of the active core when the aptamer is the fluorophore binding conformation.

11. The RNA aptamer according to claim 1, wherein the leader and tail bait sequences being contiguous in the target sequence.

12. The RNA aptamer according to claim 1, wherein juxtaposition of the 5' terminus of the active core and the 3' terminus of the active core when the aptamer is the fluorophore binding conformation brings a phosphate group from the 5' terminus to within 10 Å, or to within 9 Å or to within 8 Å, of a phosphate group from the 3' terminus.

13. The RNA aptamer according to claim 1, wherein the aptamer has a fluorophore binding affinity of at least 400 nM, 300 nM, 200 nM, 100 nM, 50 nM, 40 nM, 30 nM, 20 nM, 10 nM, 5 nM, 1 nM or 0.5 nM when the core is in a fluorophore binding conformation.

14. The RNA aptamer according to claim 1, wherein the fluorophore-aptamer complex has a brightness of at least 7,000 $M^1$ $cm^{-1}$, 8,000 $M^{-1}cm^{-1}$, 9,000 $M^{-1}cm^{-1}$, 10,000 $M^{-1}$ $cm^{-1}$, 43,000 $M^{-1}cm^{-1}$.

15. The RNA aptamer according to claim 1, wherein the fluorophore-aptamer complex has a fluorescent lifetime of at least 1 ns, or at least 2 ns, or at least 3 ns, or at least 4 ns or at least 5 ns, or at least 6 ns, or in the range of 1-6 ns.

16. The RNA aptamer according to claim 1, wherein the fluorophore-aptamer complex is fluorescent in a formaldehyde solution.

17. The RNA aptamer according to claim 1, wherein the secondary aptamer sequence has affinity for a secondary target moiety.

* * * * *